United States Patent 7,745,391 (HUMAN THROMBOSPONDIN POLYPEPTIDE) - sequence listing, part 99

SEQ ID NO: 309623 - DNA, 3518 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309624 - DNA, 3405 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttgaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309625 - DNA, 3850 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309626 - DNA, 4529 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactgtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagaagagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctgaaaaaaaaaaaaaaaaaaaaaaaaaaaaaaaaaaaaaaaaaaagaaggacaaaacaaaaggagggggggggcaaaaaaacggagggggggggggcagaaacccccgtggagagggccacacgacgccaacactaacgacaaccgtcccaccgccgcacttcacacctccgaccacgcacccgccccgctacgctaccaggcgacacacccaccccgacgtacaaccagcccacaccccggggatcagcaccggcccacaagccaacgctcgccgacaacacccaacacgcagcaactatagcactgtgaaacatccgcggccaacaagcgccacaacacaccaggcagaagcagaacaagcgaggcgcgaccaccgcacccccacagcacagagcgccacgagcaaagccaatacaa

SEQ ID NO: 309627 - DNA, 3147 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtatggcggtgtgcgcctgtagtcccagctactcgggaggctgaggcagaagaattgcttgaacccaggaggcggaggttgcagtgagccaagatcgcgccactgcactccagcctgggcgacagagcgagactccatctccaaaaaaaaaaaaaagtgaggttgagatttgcatggtaccaaggcttacatgcttcagaatagatcaatggttattgtataagtaattttatcctaaaacattatgacattttttgtttcttattgagggtagataatgttaatattaaactactaataggaggcccttatcacttctcttttcattttttccatgcagtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagaagagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctga

SEQ ID NO: 309628 - DNA, 3696 bp, Homo sapiens
  misc_feature (41)..(41): n is a, c, g, or t
  misc_feature (83)..(83): n is a, c, g, or t
tttttttgagatgaagtctcactctgtagcccagactggantccggtggcacgatctcagctcactgtagcctctgcctcctnagttcaagtggttctcctgtctcagtctcccaagtagctggaactacagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309629 - DNA, 4026 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggtatcatcatcccatttcaactctaaggtttggaaagttttcattgaaagaataagatgtattgtaacaaactccaaactttatgcatgcagttactacaaccactggactcaactgtaatgaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309630 - DNA, 3851 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagagatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa

SEQ ID NO: 309631 - DNA, 1468 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaaggaaggtgtggtttgatacttgagtaaatatgcatgctttattaaagatgaagaaagg

SEQ ID NO: 309632 - DNA, 379 bp, Homo sapiens
aaaaatataaaaattagtcgggcctggtggcgggtgcctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgt

SEQ ID NO: 309633 - DNA, 6649 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggta

SEQ ID NO: 309634 - DNA, 515 bp, Homo sapiens
gccccccagagcagcgcaatgcctgcctggctcccttagcccctgccctgtgccactcttctgagctcctcacgcgccatctcttaattctcaccatgaccctgcccggaaggcactattgttacctgcagttttcagatgtggaaactgaggcccagagagattaaaggccaaggtcctgtggctaggagctctcggtcttcagagactatggtggagtcaaagtctcctctccccgtctcttgtgcggaatggaataaccaggtggtgattccctgcggtgtgcaagtccgactggaacagaaagccagacagaggaagtgaccagagcaacaagaccaaccaacacaaggacaggacagatgtgactgtcaggaagtcttgcaggtcacgtgctgccatccctgcctctgccccagtgaccgtgatggagtctcatgaagctatttgattctttcagaaagaatgctgaccaaatggatgatgaggagcttcagataaatgaaatcacttta

SEQ ID NO: 309635 - DNA, 6275 bp, Homo sapiens
tctccggttttctcccccgcagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggta

SEQ ID NO: 309636 - DNA, 3913 bp, Homo sapiens
ggagccaggacacaggtgaggccgggccacttttggctttttccagcctgttctctgagctcactgcaagccattccttctcttggcaaccaggatttgaggacacatgcttccctcatggttgtttctcaagggcctctgggctccttacctataacagtagttgggtttcatattaatgtgactgttgtccatacccaccctgagaccagagaaggtgccttgggctccacctgggacacgagggtttaatactgctgcagggcgaatagaaagctccctctggctggtgggaaggcaaagccacaccaggcgggtctgctttgctctagtaactcgcttattctctgccttgacatgggagtaagtgcatccttggagcactcactgttcatgttttcagaattaggggcaaaggccatctgccttacatgcacccagcataggccacatgcgcaagttgttcataaacccagtctgcacatcagcaactgcctgtgtgttaacaggacacacctgtcccaatagttgcaactaacatgtgtctcccttggtgtcttccagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggta

SEQ ID NO: 309637 - DNA, 7089 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggtaaaaaaaaaaaaaaaataaacaaaaaaaaaaacaaaaacacaacaacaaaacaaaaagaaaaaacaaaaaaaacaaagacaaaaacagccacaccaccccccactccacacacccaaggcgggcgctcgaaaactctacagccgcagcagggtccaaccatatatacccactcgaccccgtagtaataggagaacggggcgcaccattcacggtgctcttgcttcaactacagctcaccgcgcggcgagcacctccatcggcccgacgcgagcgaaccaccacccctcccgctcatgacgaacaaccccctactgtccgtggagatcagcacgaagcgaccccagcaacaagtacgcgaccgtcggcagcaaccacaccgcgttgtgcacacacacttctgcctgcggccacaatcccgtcgctgctaaatactccggggt

SEQ ID NO: 309638 - DNA, 6555 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccctaagtgctaggattacaggtgtgagccactgcccagccaggagaagaattctaaaaggaacacttttccttgcatggattgacataagtaattcagattccccagtgatgactactgctgtgtgcttcttggtctgttggcaacctga

SEQ ID NO: 309639 - DNA, 973 bp, Homo sapiens
gagaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggta

SEQ ID NO: 309640 - DNA, 5865 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttcttgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaagcctccgtgagacggta

SEQ ID NO: 309641 - DNA, 4225 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattctgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctcaaagatctttggggatcctctgaa

SEQ ID NO: 309642 - DNA, 889 bp, Homo sapiens
gagaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaa

SEQ ID NO: 309643 - DNA, 828 bp, Homo sapiens
aggtggcgacctctgcacatggaggatgctgaattctacaacgcggttcaagggccgcaatgacctgatggagtacgcaaagcaacacgggattcccatcccggtcactcccaagaacccgtggagcatggatgagaacctcatgcacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccaggtaggatgaagatgtcagctcgctgtcttgaggtgctaaaagctgggcctgcatggggctgaaggctgtctgcgcgggagctgttctggataccaagggctcggctgacctgtgtttcccattccccagtgctgggttggtcagtgcctagaaacccagtttccagttaagcgtttacacttgtgaaagtggcattttccaggttgggtgactgtgtgattgattctaagtacttccatggaggcattaaaaaaataagtgaccccactgtcccttgttctttaatagagaattctctaacaaaaaataacagagataaaagtc

SEQ ID NO: 309644 - DNA, 602 bp, Homo sapiens
ccccgactagcccgacagtccccgactagcccgacagccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaaggtgcgtgtgttcatcttgtgtgcagttatggaggcaaagggcacagggaagacagcccactcaaatatctgaagtattttgcagtctgctaagaagaaaaaatttcccctgttttctcagaggtccagaatcacaccttcgtgtgacacagttgtgagttttgagggtcttcgtgagaataaggcatggtgagtttgggtcagggc

SEQ ID NO: 309645 - DNA, 510 bp, Homo sapiens
acgagcttgttggaaagatgacttgagcaatccacacaaagcacagtgcagccttaggcatcattgttattagagctttgttaagaagcattgtgcaggggtaatatatatggttgaagttggagttggcttgatgtcaaccctcctgattcaagatccaacaaactgtatgctttagtctttatataatttggtaatgatgtgtctatgataagaatgataaacagttccatttacttacctctcaactatcttgtggaactttatacttctttgaagttttacacaaagctgcacactaatctaacataccagttgctaaaaagataagggctcagcctttgcatccgtttcattccagctgataaattggctgagcacacaacatctacagcagttgttgactcttgtttgctgtctgtccactttgcagggagcctgacggccttggtgtgccagcattccatcacgcccttggccttgccgtgcaagctgcttatcccagagaga

SEQ ID NO: 309646 - DNA, 388 bp, Homo sapiens
caggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggtgagctgggtctccatgggaggtgctccacgggaggtgctccacgggaggctaatgtgtgatgagaaatcagcctagtaggttagcttttggcgaaatccacaagggagggacatttcccttgcagtttcaactcttgtgaattttggcctaggatccaaatgctgtcatgctggtgtggtcccttggtaggagatttggaggatgggaagaac

SEQ ID NO: 309647 - DNA, 422 bp, Homo sapiens
cctccctgaaggtccctcaactgcatggacatgtagttcttccagccaagcagagggatcccggccaggtccccactgatccagtttgcaaaaagagtaaggggagaggacctacccaaggttatgagtgggcatagacctttgtccacccggcagaccttcttgtctttctcctccctttctccagccatcgccatgttgaaggacaaggagccgggctcattcattgttcgagacagccattccttccgaggggcctatggcctggccatgaaggtggccacgcccccaccttcagtcctgcagctgaacaagaaaggtaaggttactgctccctattgatctgttcagctcatccacagagaaactctgttggtttatttttaggctaataaaataaaagatgactttaacaatactca

SEQ ID NO: 309648 - DNA, 1670 bp, Homo sapiens
tttgagatggactcgctctgtcgtccaggctggagtgtgcagtggcatgatctcggctcactgcaacctccacctcccggactcaagcaattctcctgtctcagcctcccgagtagctgggactacaggcacgcgccaccatgcccagctaatttttgtatttttagtagagacggggtttcaccatattggtcaggccggtcttgaactcctgacctcaggtgatccgcccgcctccgccttcgaagtgctgggaatacaggcatgagccactgcgtctggcctctttttttgttcccgttatcacactgataacattgaattgcaatcttttacttacacatcttccttactaaacagagcttataaagatcagagatcctctattttcccccttaatctttttaatgtatataaacaatggaatgaataaatcaatgaatgaatgtctgaggaaacttaactacaccaaagtgtattggcagactaccagactttttaaacagctttattaagatataattcacaaaccatacagttcatagggtggtgcaaccgccaacacaatctaattttaaactatgtttatgctgctacgagaaagcctatacccataagcagtcattttctattccccacccccaaacccactccttagccctaggcaaccactaatctactttctcagaccgataactttagcataggtataaatcgatcacagagcctcaaaatccacccgatatctgggccatgatgtgaaatttggtaggtaatcgtcccacgttatcaacttgtaaagtagaaatggaagtgggggggaaaactcagccgccagtggcgtttgtgaaaagcacctggtaacaggctgtgctggaggggagttcagcccctagaaaagatcacggattaggaattacataagcataggtctcgggtccttttattttggacgcgatcctttcacgggatcgcctccggatgggagccggatgggatcccggacgggatcgtctcgctgggagccatgcaggaaaccgcaagagtcagaaacaggcgttgaaggcaggcagcattttccaaaacagctgtgtctcgggagctgccgggctgtagcgtctccccgagtcgcgcgcgcatgacgtggcgggcgcgcgatgacgcgacgcgtggcgcggtgcacgctgggatatttaagtctcctccgcggcgcggagccgcgatgtctccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggcggcggccacccgcccgcccggcgc

SEQ ID NO: 309649 - DNA, 1696 bp, Homo sapiens
tttgagatggactcgctctgtcgtccaggctggagtgtgcagtggcatgatctcggctcactgcaacctccacctcccggactcaagcaattctcctgtctcagcctcccgagtagctgggactacaggcacgcgccaccatgcccagctaatttttgtatttttagtagagacggggtttcaccatattggtcaggccggtcttgaactcctgacctcaggtgatccgcccgcctccgccttcgaagtgctgggaatacaggcatgagccactgcgtctggcctctttttttgttcccgttatcacactgataacattgaattgcaatcttttacttacacatcttccttactaaacagagcttataaagatcagagatcctctattttcccccttaatctttttaatgtatataaacaatggaatgaataaatcaatgaatgaatgtctgaggaaacttaactacaccaaagtgtattggcagactaccagactttttaaacagctttattaagatataattcacaaaccatacagttcatagggtggtgcaaccgccaacacaatctaattttaaactatgtttatgctgctacgagaaagcctatacccataagcagtcattttctattccccacccccaaacccactccttagccctaggcaaccactaatctactttctcagaccgataactttagcataggtataaatcgatcacagagcctcaaaatccacccgatatctgggccatgatgtgaaatttggtaggtaatcgtcccacgttatcaacttgtaaagtagaaatggaagtgggggggaaaactcagccgccagtggcgtttgtgaaaagcacctggtaacaggctgtgctggaggggagttcagcccctagaaaagatcacggattaggaattacataagcataggtctcgggtccttttattttggacgcgatcctttcacgggatcgcctccggatgggagccggatgggatcccggacgggatcgtctcgctgggagccatgcaggaaaccgcaagagtcagaaacaggcgttgaaggcaggcagcattttccaaaacagctgtgtctcgggagctgccgggctgtagcgtctccccgagtcgcgcgcgcatgacgtggcgggcgcgcgatgacgcgacgcgtggcgcggtgcacgctgggatatttaagtctcctccgcggcgcggagccgcgatgtctccggcggctgcggcggctggagcaggcgagcggcggcggccgatagcgagtgtcagggacggccggggccggggctgcggcgggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggcggcggccacccgcccgcccggcgc

SEQ ID NO: 309650 - DNA, 1652 bp, Homo sapiens
tttgagatggactcgctctgtcgtccaggctggagtgtgcagtggcatgatctcggctcactgcaacctccacctcccggactcaagcaattctcctgtctcagcctcccgagtagctgggactacaggcacgcgccaccatgcccagctaatttttgtatttttagtagagacggggtttcaccatattggtcaggccggtcttgaactcctgacctcaggtgatccgcccgcctccgccttcgaagtgctgggaatacaggcatgagccactgcgtctggcctctttttttgttcccgttatcacactgataacattgaattgcaatcttttacttacacatcttccttactaaacagagcttataaagatcagagatcctctattttcccccttaatctttttaatgtatataaacaatggaatgaataaatcaatgaatgaatgtctgaggaaacttaactacaccaaagtgtattggcagactaccagactttttaaacagctttattaagatataattcacaaaccatacagttcatagggtggtgcaaccgccaacacaatctaattttaaactatgtttatgctgctacgagaaagcctatacccataagcagtcattttctattccccacccccaaacccactccttagccctaggcaaccactaatctactttctcagaccgataactttagcataggtataaatcgatcacagagcctcaaaatccacccgatatctgggccatgatgtgaaatttggtaggtaatcgtcccacgttatcaacttgtaaagtagaaatggaagtgggggggaaaactcagccgccagtggcgtttgtgaaaagcacctggtaacaggctgtgctggaggggagttcagcccctagaaaagatcacggattaggaattacataagcataggtctcgggtccttttattttggacgcgatcctttcacgggatcgcctccggatgggagccggatgggatcccggacgggatcgtctcgctgggagccatgcaggaaaccgcaagagtcagaaacaggcgttgaaggcaggcagcattttccaaaacagctgtgtctcgggagctgccgggctgtagcgtctccccgagtcgcgcgcgcatgacgtggcgggcgcgcgatgacgcgacgcgtggcgcggtgcacgctgggatatttaagtctcctccgcggcgcggagccgcgatgtctccggcggctgcggcggctggagcaggcgagcggcggcggccgatagcgagtgtcagggacggccggggccggggctgcggcgggccggccggggcggcgcttctcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggcggcggccacccgcccgcccggcgc

SEQ ID NO: 309651 - DNA, 225 bp, Homo sapiens
ctgcaccttcttctcatctctctgagttgccccagaggcatctatacctttccaacttttctatccccaaaacaccctaatctccagcgatactgaacaattccatctctggacttctgcacagtgctccttcatcttccttgaacctgccagacctctcagctccaggagcacttccctgccttccttcccctttatcacaacttttttttttttttttttttt

SEQ ID NO: 309652 - DNA, 895 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309653 - DNA, 1049 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtgatttttgtccaattcatttccatgttctcaagacattaaggaatgttatgcgaaatacactaacttaaaactgtgtttatattttgccctgccattataaataaagacacgtgctgctgtcactcactgagtacaaatggctgata

SEQ ID NO: 309654 - DNA, 947 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgcacaacacaacaacaaccaacaacattcgccgccctcccccaaaacttgaac

SEQ ID NO: 309655 - DNA, 922 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagttgcggtctaaaatggagatggtaattcttatcctatgaaacttaatttttttataaaaactttgagttccgggtttggcacacatcccggtccgactaggggtggcaaacaccttagg

SEQ ID NO: 309656 - DNA, 975 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaattagatccttataggagtgccgtctaaatggagatgtattcctattcctgggcacttatttttcaaaaaaaaaaaaaaaaatttggggcccccaaaagttaacatgtgggccggccggagaaagtaaattcaaacgccgaggggttcaccaaccggggggaaaagttgtgttactctcttcctgcggggggggca

SEQ ID NO: 309657 - DNA, 1617 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtgggtattttgaatgtgttctttctaactacatgcatctctccactcaactccaccccatcccatcccaccttgaaaatcactgctctgaaccagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtgatttttgtccaattcatttccatgttctcaagacattaaggaatgttatgcgaaatacactaacttaaaactgtgtttatattttgccctgccattataaataaagacacgtgctgctgtcactcactgagtacaaatggctgata

SEQ ID NO: 309658 - DNA, 598 bp, Homo sapiens
accgcccaacccacaccaatggaaaatttaaaatttttttcgcaccagttcccgggagcaaaaacgggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309659 - DNA, 810 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacaagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309660 - DNA, 823 bp, Homo sapiens
gggccttagagaggatctcggtcacttgaatgagcggcggcactgcagccaaaggtcttcacggggcagaagagggagtacagctgatgtctgctgtgcggcagggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggggtcggatttggacatcccggggtttggacggtgtgccttcttactacatggtttttcccttcaattcccccattcctttcccctgtagaatctggctgtgaccgggtcccccctggcccccagtccctggagtgccccttttggggggcgccgccccgcggacctttg

SEQ ID NO: 309661 - DNA, 1534 bp, Homo sapiens
gaattctggaatgtgtctgctcctagcagcagggaggaagtgtgtaactagagaggagcctattcagcaggtgtcatgactgtggcttggcgtgggtgacgcaccctcatccggggtgagttaaccatcttatgatggaccagcgattaaaggagactcaaacaccactacacccccctggttgaggacagagctcacttgtgttgctttgttttgctttctttgttttgctctgtcgtccaggtgtgagtgcaatggcaccatcacagcttactgcagcctcgacctcccgggccaaagcaatccttccacttcagcctcctgagtagctgggactacaggcatgcaccgccatgcctggctaattttgtattttttgtagagacggggtctcacgatgttacctaggctagtcttgaactcctgggctcaagcgaccctcccacctcagcctcacaaaagtagtaggattacattcatgagccactgtgcctggccctcacctgtgttttaacaacacagagagatgattgtacttaataaaccatggacctgaaaaatcagagacgtaatgcaaatacttttccagctgtatttagaaacgaactccttccttcctgattgctgtgacccagtttacaatcttaggtgtggtccctgatgcagagaaagcagagttcaatctaggtggtctgactgcagccaatcagaattctccttctgaaacatgtttctgtagagtgaaatttttaaatccctttgacaagttggacaagctcatgcatagcacacaacttgaaaactcttctggcgtaaaaacattctcgagttaataatgttaccccttataacagaaaggaagtcctgtcctgtgagcatatacataaggaggttttaaagtgatttgaaaagtttggaatcacgggaaatatttagtggtaggatagaaatgttctgtctaatctagtaatgtagtaatgtcctgggtcgtgtgcttttttaggtgcctcgagtctttattggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309662 - DNA, 1463 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtgggtattttgaatgtgttctttctaactacatgcatctctccactcaactccaccccatcccatcccaccttgaaaatcactgctctgaaccagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309663 - DNA, 1313 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtgggtattttgaatgtgttctttctaactacatgcatctctccactcaactccaccccatcccatcccaccttgaaaatcactgctctgaaccagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309664 - DNA, 919 bp, Homo sapiens
gaagctgtccctttaaaactcgagcaagctaccaggcaaactccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagtgttctccaccttgtcctccacagatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatg

SEQ ID NO: 309665 - DNA, 417 bp, Homo sapiens
tcaaggccatctgcaacagagtgtgtttaaatggcaggtgtaagtgttctggtaatgagagaaaggaaggattttgccttacaaggagatcccttctttctttcctggcagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggccaagaaggttgacgggccatcttggttttcttctggatgtgctctttggttttcagaagactgtgacaagttctggcccaggattcgctcactgaccctcaattgtcctctttggcatgcgtttcttactgttctccatgtgtcggcatgtct

SEQ ID NO: 309666 - DNA, 322 bp, Homo sapiens
tagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaat

SEQ ID NO: 309667 - DNA, 656 bp, Homo sapiens
  misc_feature (477)..(477): n is a, c, g, or t
ggagtgtaccgtggggcctcactagcctctaactccctgtgtctgcatgagcatgtggcctccccgtcccttccccggtggcgaacccagtgacccagggacacgtggggtgtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagtgccaccacccncggcaggccttccctgacccgagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagg

SEQ ID NO: 309668 - DNA, 6028 bp, Homo sapiens
  misc_feature (3594)..(3594): n is a, c, g, or t
gaattccgtgggcggaggtctgggatctcctggctgttgctgtcttctgctctcatcctgcaggtgggactctcagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacaggaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactgatcgtgaaaaccagtccattctgatcacgggagaatccggggcaggaaagactgtgaacaccaaacgggtcatccagtactttgcaacaattgcagctactggggacctggccaagaagaaggactccaaaatgaaggggactctggaagatcaaatcatcagtgccaatcccctgctggaggcctttgggaacgccaagactgtgaggaatgacaactcctcccgttttggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309669 - DNA, 449 bp, Homo sapiens
agctgcccatgccgtgtgcaaatctgccccctcctctccagtgacattcccactttctcattcttagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309670 - DNA, 5571 bp, Homo sapiens
  misc_feature (3137)..(3137): n is a, c, g, or t
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309671 - DNA, 5430 bp, Homo sapiens
  misc_feature (2996)..(2996): n is a, c, g, or t
aaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309672 - DNA, 5678 bp, Homo sapiens
  misc_feature (3137)..(3137): n is a, c, g, or t
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgtaagtgagataggtgctgactgcggcaggcagaccgtgctgtttcccgtggtgagttctgagagaggcgcgtgctgatataacctgcctgggctctttggttttaggatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309673 - DNA, 5311 bp, Homo sapiens
  misc_feature (3137)..(3137): n is a, c, g, or t
  misc_feature (5132)..(5132): n is a, c, g, or t
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagattgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccgaggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagtgccaccacccncggcaggccttccctgacccgagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaagg

SEQ ID NO: 309674 - DNA, 4131 bp, Homo sapiens
  misc_feature (3137)..(3137): n is a, c, g, or t
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacggagaacaaggttaaaaaccttactgaggaactctccgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgcgtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcngagttcctgaagctgcgcagggacctggaggaggccacactgcagcacgaagccatggtggccacgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaagatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaa

SEQ ID NO: 309675 - DNA, 2398 bp, Homo sapiens
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggcagaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggagattttaaacaaagataccgagtgctgaatgccagtgcaatcctggagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcggagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaacgggaaatttgttggatgctgaggttgcagtgagccgagatcgtgccactgcgctccagtctgggccacagagtaagactctatc

SEQ ID NO: 309676 - DNA, 1466 bp, Homo sapiens
cggatcacctgaggtcgggagatcgagaccatcctggccaacatggtgaaaccccgtctctattaaaaatacagaaattagccaggtgtggtggcacgtgattgtagtcccagctactcaggaggctgaggcaggagaatcacttgaacccgggaggcagaggttgcagtgagccgagatcacgccactgcactccagcctggtgacagagcgagactccgtctcaaaaacataacaaaacaaaacaaaacaaaacaaaaattttagggggactaggctcctactcaaattacccataagatgaataggaactattgggccatggtagaatctggtctccccctgaatcccgccccatacagggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatcgagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcaggccagcccttctggagcaggacagaagatatgcaaaatgtatattttcttgattcctgaccattgatacttaatgtccatgtgactctttttcacatgcaataaactttgctttgtttcaa

SEQ ID NO: 309677 - DNA, 483 bp, Homo sapiens
atgaattcgatgaatttatttttattactaggcgtttccccatctcatgtgtctttaaatgcggtgctgggccattagagggacctggcgttagcacattttattaaaacaaacagctttgatcttggtcagacacaaggcaagttattgatcccagattttgagtagacaggaaattctcctgggcgtataaaaacacatgggtgtctgaatcacatagattagtgattccaacttgatgaatagtgatgttcaagtggatggaaactgaaataacagctgcttctctttcatattctttaaggaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttg

SEQ ID NO: 309678 - DNA, 351 bp, Homo sapiens
tctttgattctgaaagaagtctaacttttcacatgaatgttgtatttttttattagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaaggtatccagttccatccccaccgtaagctcttctcatagactcttctgctcattactgcagctcatatttacctctctgcactttgccttgccttcaatccagcctatgggcatcttctccatcc

SEQ ID NO: 309679 - DNA, 545 bp, Homo sapiens
cgagaccaacctgaccaatatggagaaaccccatctctactaaaaatacaaaattagccgggcatggtagtgcatgcctgtagtcccaggtactcgggaggctgaggcaggagaatcacatgaacccgggaggtggaggttgcagtaagccaagatcgtgccattgcactgcagcctgggcaacaagagtgtaactccatctcaaaaaaaaatgtttcctcttcttccctcaatttcttgcattaggggactctggaagatcaaatcatcagtgccaatcccctgctggaggcctttgggaacgccaagactgtgaggaatgacaactcctcccgttttgtgagtctgagtttggttaagatggaatttgctttgtgcctcacaaaataggcaagagccctgtcctcaaagagtgtagagaccagaggcaacagatgatgaaaaacaaaacaacccaacaagaccatttcagataaagataaattcagaccaagttcaatgaacagcgtgtgtaagagaggaactgggggccaggcttgctttag

SEQ ID NO: 309680 - DNA, 471 bp, Homo sapiens
gaaaacctgaacaagctgatgtcaaatttaagaactactcaccctcattttgtgcgttgtataattcccaatgaaaccaaaactccaggtgagacacctgctggctcgctaggtggtgctcagtttttaagaaattctgtgtaaggctgatatctcgcttctgttcccaggggctatggaacacagccttgttctgcaccagctgcggtgtaacggtgtcctggagggcatccgcatctgcaggaaagggttcccaaacaggattctctatggagattttaaacaaaggtgtgtaataaacatgttctatatgcttggggatgagatgtacgaacactggaatttgagagggagaaagattcgtatgaaaagacctatttcgaaagaacagatatggacctccatgtaaactgaacaatctaccatttggccaagttatatatatttgtttcttccatgtttttctctgga

SEQ ID NO: 309681 - DNA, 608 bp, Homo sapiens
  misc_feature (38)..(38): n is a, c, g, or t
gaagaaagaaagaaagaaagaacgaaagaacgaaagancgaaagaaagaaagaaagaaagaaagagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaacaaattgaggggatatatgaggggggacgaagcggtctgaatggcatgtgcataggcggtttctggacaagttttggccacgtggaaattggcggtccaa

SEQ ID NO: 309682 - DNA, 4455 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309683 - DNA, 3937 bp, Homo sapiens
gtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgtggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309684 - DNA, 3793 bp, Homo sapiens
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309685 - DNA, 3984 bp, Homo sapiens
ccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309686 - DNA, 3946 bp, Homo sapiens
  misc_feature (1)..(1): n is a, c, g, or t
  misc_feature (7)..(7): n is a, c, g, or t
  misc_feature (11)..(11): n is a, c, g, or t
  misc_feature (17)..(17): n is a, c, g, or t
  misc_feature (19)..(20): n is a, c, g, or t
  misc_feature (22)..(22): n is a, c, g, or t
ntcctgntcancctcananngntgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309687 - DNA, 3188 bp, Homo sapiens
tccagcgtcaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309688 - DNA, 2084 bp, Homo sapiens
tccagcgtcaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309689 - DNA, 2823 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309690 - DNA, 712 bp, Homo sapiens
gcagtaactcgggtataggtacgaggctgggtgtcgctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309691 - DNA, 2035 bp, Homo sapiens
ttttcgagcactgttggcctactggatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgcgcctggccaactctctcacattttaaaacactactttctgctacaaaagtggcgtgtacaatgggaaatgtcacaaataaataccccaggaagacactcaaaagcccctgtgatgcccccccagccctggtcctggggtgtcggcctcgggtctccctcctggtgcggcatccttttaccactgcagttaactgggaggaaacgatccccatgcattgctctaaatcccgctggatctggttttgggggtgctgggctgctgcccaggagactggaaggggaggaaggtgtgtggcccctgagggcttccaaagcactctgtgctgtgaggatcccaccccgtgcgctcccagaaagtggccggtgtttttctgctccagcagggagcccaggtgaggttctctaggtaggtggaaaggtaggtggagcaggcttcaagagcagaacccagcagagcgccccggcttcctcccatcgccctcctactccctctcctcccctctcctcccctcccctcccatccttttgtaagcaaggaggggagaggcttccaccgaagttgggcccagctcaggtgtcctgagtggtgggaatctgtgcagggcccaggcgcatttcctgcccgggagcaggaatgctttacagatgttggagctgcctcaaggcatggccaggaggggccggagaagcagaaccagctgcataggggatgctgggctggtgcctgcacatggaacagtcattgattaaaatgtcacttgtaaggtgcctaaatcttcgggtcctcctccttggagagtcccaggtaagctgcgttccctgggctgattccaggctgggccaggcggggctgggctgcagacctctggggactgcctacccaaccccacaccaccaggctccctgctcctcctgaaggccttggccttcagtaaaatgcaaaaagttaaatgctctgggttttctctgataatagaagcaatgcctgtccattgtagaatgttgggaaaatagagaagagcaagagcaacaacaggcacggaactccacccctgccggtcagcctgcctgtgcgtgggagttaaaacaaaacgcttctgcaaacatttgtttttttttgtttttccaaaattaagctccgattgtgcatatcacttgataatcgaaattattttttgaaaaataattttaatagctatgcagtactccatcctgtcaacatatggaatgaaatgatgatttctaaattcttactcttgtcacctgggctgcagttggaggcctggtgggggtccgtgcggcgactggctgggccgtccctgtccctcctcccagatgacagaggtgcctggtgtttggcaaactcacttagaaggagcaagaagcaactgggatggctcagaagcccatggtggaatagtctgttgtaaacgaagagacaagaggaggccgagggctggtttccccttctccttcccgctcccagccctcccctctttcccatcgagtctctggtctctgccttcaggcccatggatgggcaaagcatctttcgagagcttgcctgccaaccctcagagtcacatacacgaaggtctcctggagctcagaaggtcagacacaaagtcactccttgaccctatttattgaaatatccgtttttttgagcacttttcccgtgtagactcaacagggtctccctctgttgcccaggctggagtgcagtggtgcgatcatggctcactgcagccttgaactcctgagctcaagcaatcctgctgcctcagttctccgagtagctgggaccacatgtgtaagtcactaagcctggctaatt

SEQ ID NO: 309692 - DNA, 764 bp, Homo sapiens
gcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggaagcgcacgatggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactggacgcgccatcgtgcgcttcgggatcctctagatcagcctgcgacac

SEQ ID NO: 309693 - DNA, 1344 bp, Homo sapiens
gcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggaagcgcacgatggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgcca

SEQ ID NO: 309694 - DNA, 759 bp, Homo sapiens
gcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggaagcgcacgatggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgatcttcgtgatcgcttcctggattaccatggatactcaagaa

SEQ ID NO: 309695 - DNA, 1734 bp, Homo sapiens
agcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctacttgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccc

SEQ ID NO: 309696 - DNA, 383 bp, Homo sapiens
tctagcggatcgctgatgctactccacaaacagagtgctaccttcacaaacagagtcagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttaccttgtggaggtagcactaactta

SEQ ID NO: 309697 - DNA, 1002 bp, Homo sapiens
  misc_feature (182)..(182): n is a, c, g, or t
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaanatcttttgaggtcgagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggaggagggagggagggagggagggagggagggagg

SEQ ID NO: 309698 - DNA, 676 bp, Homo sapiens
gcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggaagcgcacgatggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcagacgcgccatcgtgcgcttcgggatcctctagatcagcctgcgacac

SEQ ID NO: 309699 - DNA, 3290 bp, Homo sapiens
gcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggaagcgcacgatggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309700 - DNA, 3487 bp, Homo sapiens
ccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309701 - DNA, 3250 bp, Homo sapiens
agtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309702 - DNA, 3016 bp, Homo sapiens
gctggatgcacagggacgtggtcctggctctgggggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309703 - DNA, 3537 bp, Homo sapiens
agcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309704 - DNA, 2989 bp, Homo sapiens
tggggcttagttgtatattactgtgccctttgttttacaattaacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309705 - DNA, 4390 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaaatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309706 - DNA, 2844 bp, Homo sapiens
ttgttattgggcgttgttttgcagtgtctctgagtgtgcgagacctggtgatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309707 - DNA, 2735 bp, Homo sapiens
tctactccacctcttgatcttctctcaccttatgcaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309708 - DNA, 2717 bp, Homo sapiens
tgctctagaggataaaattccggctttgggcttcccatcgagatcaagaccatcacgcacggatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309709 - DNA, 4126 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccacgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309710 - DNA, 2616 bp, Homo sapiens
cagaagaaagaaacaacttacggctaggtacgaggctgggtgtctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309711 - DNA, 2519 bp, Homo sapiens
ctggctgttctagaggatcccgaagcgcacgatggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309712 - DNA, 2716 bp, Homo sapiens
gtgtggttgggaccccagaactcatggacgagggtgcttggagctggccctggcccgcctggcctgtgcagtggtgtcacctgtgtctgggacacacccgtgtccttcctctgccccacactcacagcgtggccgacttggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309713 - DNA, 4566 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaacaaattgaggggatatatgaggggggacgaagcggtctgaatggcatgtgcataggcggtttctggacaagttttggccacgtggaaattggcggtccaa

SEQ ID NO: 309714 - DNA, 2434 bp, Homo sapiens
tcaggaggacagctcaccactcctgctctgcccctctgcattgggggcatgtccgtgaaagagcagatggagaccatccgacacggtgtacacatgatggtggccatcccggggcgcctcatggatttgctgcagaagaagatggtcagcctagacatctgtcgctacctggccctggacgaggctgaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309715 - DNA, 2257 bp, Homo sapiens
  misc_feature (13)..(13): n is a, c, g, or t
caggctggtactncccggaattatgggatgttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309716 - DNA, 4561 bp, Homo sapiens
  misc_feature (4461)..(4461): n is a, c, g, or t
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaanaaaggaatcggggcacaagtgcgcgcggcaacgcggaacaagccactgcgcatagtgtcgggccttctgacaagggaccgcggcccaaggacgaaacaac

SEQ ID NO: 309717 - DNA, 4631 bp, Homo sapiens
  misc_feature (4545)..(4545): n is a, c, g, or t
  misc_feature (4553)..(4553): n is a, c, g, or t
  misc_feature (4572)..(4572): n is a, c, g, or t
  misc_feature (4595)..(4595): n is a, c, g, or t
  misc_feature (4610)..(4610): n is a, c, g, or t
  misc_feature (4631)..(4631): n is a, c, g, or t
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagctagtaaagagggtccctcccacagagctgtgctgaccctgggttcacatagcagggactgggggtgtacaaaaggggtcctgctgtgnttgttaantcagtttcccctcttggtnaccctagctggaagagggggggncccggtacccaattngcctataggtgagccgatttn

SEQ ID NO: 309718 - DNA, 4521 bp, Homo sapiens
  misc_feature (4514)..(4514): n is a, c, g, or t
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaaaaaaaaaaattaaaattaaaaaaaaaaaaaaaaaaacaaaaaacnaacaaaa

SEQ ID NO: 309719 - DNA, 1825 bp, Homo sapiens
gccgggcgtgtaatcggacgaggaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309720 - DNA, 1848 bp, Homo sapiens
ggaaggggcctccctcccttgtttcctggcagcatgtcgaaggggtgggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309721 - DNA, 1501 bp, Homo sapiens
gctagctaggtacgagcctgggtgttagcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309722 - DNA, 4272 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309723 - DNA, 4156 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacggactacagccaagagcgactacagccaagagcgactacagccaagagcgactgaaggggatcctctaag

SEQ ID NO: 309724 - DNA, 1181 bp, Homo sapiens
cagaagaaagaaacaacttacggctaggtacgaggctgggtgtatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309725 - DNA, 1196 bp, Homo sapiens
ggtgtccaaagtttaaactcccctccacggggttatggtagcgaggcctgggtggcggatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309726 - DNA, 1107 bp, Homo sapiens
cggacgcgtgggtcgacccacgcgtccgaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309727 - DNA, 1250 bp, Homo sapiens
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgatggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309728 - DNA, 2742 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcacccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309729 - DNA, 3470 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgctcggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309730 - DNA, 3268 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtccgtgtggggttctcagtgccggaggccttggggtgggggccaggcctcgcacttgcagaggagcccagtgggctgcacgctcccctccatccccatcggccctgtcccctggagtgtgtcagagcccaggggagaatattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309731 - DNA, 746 bp, Homo sapiens
caggcatctgcttggacggcatcaagcttgggaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309732 - DNA, 2393 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatactgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309733 - DNA, 2767 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309734 - DNA, 2558 bp, Homo sapiens
  misc_feature (2531)..(2532): n is a, c, g, or t
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccaaannaaagaagtgagagagggaaaagaaga

SEQ ID NO: 309735 - DNA, 2833 bp, Homo sapiens
  misc_feature (2826)..(2826): n is a, c, g, or t
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaaaaaaaaaaattaaaattaaaaaaaaaaaaaaaaaaacaaaaaacnaacaaaa

SEQ ID NO: 309736 - DNA, 1131 bp, Homo sapiens
gggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatactgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309737 - DNA, 2651 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309738 - DNA, 2603 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309739 - DNA, 2548 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggtcccgcaggtaggcaaactcacagtgtgtagtgttttcaacttcgatggtac

SEQ ID NO: 309740 - DNA, 2430 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcgccatcgtgcgcttcgggatcctctagatcagcctgcgacac

SEQ ID NO: 309741 - DNA, 497 bp, Homo sapiens
  misc_feature (38)..(38): n is a, c, g, or t
gaagaaagaaagaaagaaagaacgaaagaacgaaagancgaaagaaagaaagaaagaaagaaagagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309742 - DNA, 2376 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgagacacgcacacactgtgagattcactcccgccggcctatct

SEQ ID NO: 309743 - DNA, 2366 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaaggtactcgccgcaggcgccggggctccagacagatg

SEQ ID NO: 309744 - DNA, 2302 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccgcgatggcgcgtcctccttcagcaccacgccccccttcagccagcggtgccctgtgacctctgtggcgctgtcattcaaggagcaggtgaggagtatcttggagccaaggtcttctacggtagtgaagactgtgccaggttccaggactagcacgactgcctgggcgcggacccacttgaccctgggcgcccgggtcaggtggttgcgatccgggtcgttgctggcccggcactcgtaagtgcccgtgtcctcctccacgagcgtgtcgatggaaatggtgctgccgcgtgctggtggtaggtggcgtggatgtgacgcgccttcgtgcgctt

SEQ ID NO: 309745 - DNA, 2069 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309746 - DNA, 1929 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactggacgcgccatcgtgcgcttcgggatcctctagatcagcctgcgacac

SEQ ID NO: 309747 - DNA, 2150 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactggtgcccccagtaacccctgaggagcagaagtcagcatcccaactcccctcatacccgatgccagggatggcccccaccttgttgtagtatctcagatgcactgtatgccattgcccgtcactcaagccccctggaactgtggggctgaccacggtgttggattcacctggaggggagatgcatgtggaatcatcaggagcagcggagtcgccccatcccacccgtcatataagcacaaccattcccagggccaccctgatgcacaccg

SEQ ID NO: 309748 - DNA, 1978 bp, Homo sapiens
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcctctccccagggcagagcggcttgggtaaatccaccttaatcaacaccctcttcaaatccaaaatcagccggaagtatgtagt

SEQ ID NO: 309749 - DNA, 524 bp, Homo sapiens
tacgagctcgaggttgaaaccttcgcagggcaagtggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 309750 - DNA, 388 bp, Homo sapiens
accccaccccggcctggggtttcagagaaggggtccaggcaggagtgtcatcttttctcaatggggatgtggcttcagtctctgtccaggtgggtgcattgctctctttccggctcctcccaggctgcttaaatgacctgtgacgaggcctgcgccatggccggggccctctgcttttcccagcgctgcacctgggaaccaggggttgggccccggaagccgaggatgtccctgaatgccatgcctgggcacctgtcctggccaggcgaggcgtgttggggcagcggctgagatgggagcagcagcattgcctgccaggtttgagatgggccccgggtgagtgtggttaccaggaagggctgggcagagcaggcgggtgggccgcccc

SEQ ID NO: 309751 - DNA, 372 bp, Homo sapiens
gaggcagagtctcactctgttgcccaggctggagtgcagtggcgcaatctcggctcactgcaacctccgcctcccagattcaagtgattctcctgcctcagcctcccgagtagctgggattataggcacccaccaccacacccagctaatttttgtatttttagtagagacaggatttcaccatgttggccaggctggtcttgaactcctggtctcaagtgatctgccctcctcagcctcccaaagtgctgggattacaggcgtgagccaccgcgcctggccaactctctcacattttaaaacactactttctgctacaaaagtggcgtgtacaatgggaaatgtcacaaataaataccccaggaagacact

SEQ ID NO: 309752 - DNA, 262 bp, Homo sapiens
actggctgggccgtccctgtccctcctcccagatgacagaggtgcctggtgtttggcaaactcacttagaaggagcaagaagcaactgggatggctcagaagcccatggtggaatagtctgttgtaaacgaagagacaagaggaggccgagggctggtttccccttctccttcccgctcccagccctcccctctttcccatcgagtctctggtctctgccttcaggcccatggatgggcaaagcatctttcgagagcttgcc

SEQ ID NO: 309753 - DNA, 2345 bp, Homo sapiens
cgcgtaaataagacgccgaccggcgcggcgctaccgcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcaaaaaaaaagtcatgg

SEQ ID NO: 309754 - DNA, 2520 bp, Homo sapiens
cccaaaaaacatttacccagaatacaaaaaaaggacagtatagtggtcagattcccagtgacaataaacaaatcctcctctcttcaatgtttactgtaaagccagttaactgccatttatttgaaagaagaaaagaaaaacaagcccccagattggtaaacacattggcaagttgctagactccaagctggctacccttgtcaaatctgttcgagttttttcaaaatacttgggctttttaacgcacccagcctgctgggcacagttaagtaaaaggcatttactataatctaagaattccctgctattatcatttttaaatgttttcacatttttaaaactgccttacccttttggatgtatttggattccataaaggtgagtacaatcaacgagaaactgaagtgggagattctacgactgcccagagggacacgcatgcatggggctggttgtgggtgctgtgtgcagtccagaggaatcatgggagaaaggaagtcaagtccttaaacaccctacagaaacaaacactgcaatccagtatggcttattcggatgcatttaccatgaagctaccagaagaaattcaacctacgaggctactcttaaatgtaacaggatcggctatgttgacgatgtacccctcccaggaattatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcaaaaaaaaagtcatgg

SEQ ID NO: 309755 - DNA, 2430 bp, Homo sapiens
cgcgtaaataagacgccgaccggcgcggcgctaccgcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagaggtatgctgccactttttggataaaaatcctaatgaattgacacagtctgtataatttatcttttgaatttgtcatccccacttagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcaaaaaaaaagtcatgg

SEQ ID NO: 309756 - DNA, 1909 bp, Homo sapiens
aatgtattcagggggttggtgtataatctactcctttgaaggttcatgtttttgtgactagctattataggccaagtataatgccaggccatgaaaggtgaattttagggtttataaatgaattagacctagattctgcccttagaggctgattgtccagtggagaagataaaacagggaagaatcgctattttaagtttaaaagtgatgattgcataagagagacacaggtgaaagacccagttcaaagggggaacatgtctccaacttggaaccagggaagtgatggctaatagcagcatctgcctttgtggagcgctccctatgtggtaagcactgtgctaaacacgtatgtgttgccttttctggtccttatgatagttctagcagcttttgaacccaggtcttttctggtgtcaaaacctttgctcttgttcactgtgcacagtggcatttatgggaaaagagtgtgtgctgaggaggaggtagagcgaaggaactccattggactggggaatgtaagaagcagaggtgtgagataaggtgggccagagtgccgactgtatgcatgtgtgtttcccagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcaaaaaaaaagtcatgg

SEQ ID NO: 309757 - DNA, 1791 bp, Homo sapiens
ccaacctcttatctagggtttagggtctttaaagaacctattagaaccccctttcctccatgggaaaaaaccctgagatgtttgagaacctttatttactcattatttttctttccttctctcaatcagcagcacccacagtaggacaagatatggggtggagacctgcgggtagttaggcagataaccttggggcccacctgcctagtggtgtgtcagtgaaagttaatccattttcagtctcctgggtacatcttttttaactcccactttcatttttctctgcctgtttcccttcagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcaaaaaaaaagtcatgg

SEQ ID NO: 309758 - DNA, 1119 bp, Homo sapiens
cgcgtaaataagacgccgaccggcgcggcgctaccgcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaaggtttgtgggtataagttagagagttatttttgcctttaactgccctggaataatttatttgcaaaaactgcaagaatgatcattctgtacaaaatacatttttctgtagtctctctattgttagtatcatgctgactggaatttttgtaaaattgtcctttatggtgccacagtaataatgtgcttatgtggctgggcacagtgcctcatgcctgtaatctcaacactttgggaggatctcttgaaccgaggagtttgagaccag

SEQ ID NO: 309759 - DNA, 848 bp, Homo sapiens
tcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctggga

SEQ ID NO: 309760 - DNA, 1129 bp, Homo sapiens
tcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctgggaacaagcgtgtctgccctttctgtttccatattttacagcaggatgagttcagacgcccgcggtcctgcacacatttgtttccttctctaacgctgcccttgctctatttttcatgtccattaaaacaggccaagtgagtgtggaaggcctggctcatgttgggccacagcccaggatggggcagtctggcaccctcaggccacagacggctgccatagccgctgtccagggccagctaaggcccatcccaggccgtccacactagaaagctggccctgccc

SEQ ID NO: 309761 - DNA, 770 bp, Homo sapiens
ccccccccgccccccccgccgccccttggtacttggaaaaatggacaaggattgtgaaatgaaacgcaccacactggacagccctttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagccctggcaggcaaccccaaagccgcgcgagcagtgggaggagcaatgagaggcaatcctgtccccatcctcatcccgtgccacagagtggtctgcagcagcggagccgtgggcaactactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctggga

SEQ ID NO: 309762 - DNA, 629 bp, Homo sapiens
tcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagctggagctgtctggttgtgagcagggtctgcacgaaataaagctcctgggcaaggggacgtctgcagctgagccccttctggttctcccgtgcctcggtgtgatcattaggaggatggatcaacctggtgctatcgggaacgcactgcgttaatggcctcagtgcccagcaatggagaactttccactgagtatccgcatgcagcgtgcccggcggaaggtgaaagcttcaccctttgtctcccttgccatcctttggccttgtgtgtttggaagtagccagaggtggtggaacagtggtgggctggtttgggtcttgttggcagtgccaaagggacaaaggctggatgtgggcacgacctcagcctcgtgatgggcaagacaggtgggggtgactttctgttctgaaaatgacctcctccccttcttcctcccctcaagcttcctacctttcctcc

SEQ ID NO: 309763 - DNA, 324 bp, Homo sapiens
ggacaggattgctctcattgctcctcccactgctcgcgcggctttggggttgcctgccaggctgctactccggaggactggccgtgaaggaatggcttctggcccatgaaggccaccggttggggaagccaggcttgggagggagctcaggtctggcaggggcctggctcaagggagcgggagctacctcgggctccccgcctgctggccgaaactgagtatgtgcagtaggatggatgtttgagcgacacacacgtgtaacactgcatcggatgcggggcgtggaggcaccgctgtattaaaggaagtggcagtgtcctggga

SEQ ID NO: 309764 - DNA, 1134 bp, Homo sapiens
tatttaatgggaatatatcctgaggatatatgcttacttgcaaatgcttttatgtgtagtcactgtaaattcaggagtcatgaatctagtactaattttttcctttcaagctcttggaataccctttcgtgccaaattacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaaggacagtgcatccacttttcttggtgtgttgagagctgcagagaggaagggccaccttgaaggaacaccatggagttctgttggaactgaaattcttcttcacacaaaatgcaaccagttctatgatatttgttaaagtccaaataatgttttctcctaaatctgttccctactaatgtagcagtagatttgagaaaaaccacaggagaaacaattaagatgaactcacactgagatcacctaatgcctgacacctaacgatgcctcacatgcttttctatttccagcagcgcttcatacttaaaatctttctctcttggttgttgtgttttctttctggtatcctgatcataagtataacggaagtattacaaaagcttagcttctaaaagaagggaacaaaagcagcagattctattggctcattggcttctgaagtatttgtggtgcatgctttttaaaatatttttataaaagaaagattgagaacgagaaaaaaaagtgaaagaaagatactaagtaaaggtgagtttactctagagcctcgtaatatgaaatataaagaagtaaacagtactctatggacttcaaaaacctggtgtgctgcatgtactatttcttttagaacttttataaaaagaaacaaaataggatgttttaacatataactcgtgttacatacttggagatcgaaggaggtagttttgaaactccaatcatttcatcatattggcctaccagtgaggcaatgttgctcacatttctgttagccaaatttacatcaatttgattatttagactatgttttctttttcttgtaataaatactgacaaacatt

SEQ ID NO: 309765 - DNA, 1308 bp, Homo sapiens
agctacctttcaaaaacattctcagcatttcttagcagaagcaaaacaagcgaagaaaggaaatgactgcactgtgttcagcttattcaattttctccattaccttgagcttgttattttgggtccctggaaaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgta

SEQ ID NO: 309766 - DNA, 1481 bp, Homo sapiens
taatgcaactaaaatgttctcgggtttagtaccaagcgtactagtatgagaggcatgagatgttccggcagtatttacacctaattttatgagatttccaaaacttgatgatttcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggtatctaatatgagattttcaaagtttttgtgagctctgctgattatagagctggagggttctatttaattccgtttttccaatagaatatgtatatatgaaacaataaggagacaactacgcattttgttccattatagtcaggactcatgcgacttctccattacactcagtttcacagggtggggaaaagtagtcatcagaaacccatcaaaatttggactatgtgtccctaaatcatttagatagttgtctctgatgttagcaaatccagctgaataatatgaacatcagtgtctcctccatcccaaccctctggatttctcctagctctgtcttcattcaagaactctactcctcatccttgcttccagccctctgtttttatcttctgtccttaatcaagcccatggtgaccatcaccagaggcagtctcttttactgcatagtcaaagccctgtcttgtcttccctcccaaggatgcttctatgcttttgagaacatgctgacattttctggttgtgtccaaagcaacacattctgtgtgtgctcaggacaggggacaatagtctggaggggtgaatacagaaatgtccagatgccaatagctgcagaatatgcagcaatggaaagtatcagtatccatacaaagatttttcaagaaaacgaatgggctgagccaagtagctgagattgagaatgagttcatagactgtccaagatctttatcccaaaaacatttggattgtttattttcagtatttatcctctttccctactacctggatactccaaatttgcatatacttgtaatattaatatacagttcctttgcaatatttattttgttgcttcttagagaaacccaactaaatgagtttaaaaaatctgtgaaagggctgggcacagtggctcatgcctgtaatccagcactttgggaggctgaggtggacggatcacctgaggtcaggagttcaaaaccagcctggccaacatggtgaaaccctgtctctaccaaaaacacacaaaaaattggtcgagcatggtagtgtgtgcctgtagtcccagctactcgggaagctgagacaggaaaattgcttgaacccaggaggcggacgttgcagtgagctgagattgtgccactgcattccagcctgggcaacagagcaagactctatctc

SEQ ID NO: 309767 - DNA, 1156 bp, Homo sapiens
tatttaatgggaatatatcctgaggatatatgcttacttgcaaatgcttttatgtgtagtcactgtaaattcaggagtcatgaatctagtactaattttttcctttcaagctcttggaataccctttcgtgccaaattgtgagtcctgtcttatatccagacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaaggacagtgcatccacttttcttggtgtgttgagagctgcagagaggaagggccaccttgaaggaacaccatggagttctgttggaactgaaattcttcttcacacaaaatgcaaccagttctatgatatttgttaaagtccaaataatgttttctcctaaatctgttccctactaatgtagcagtagatttgagaaaaaccacaggagaaacaattaagatgaactcacactgagatcacctaatgcctgacacctaacgatgcctcacatgcttttctatttccagcagcgcttcatacttaaaatctttctctcttggttgttgtgttttctttctggtatcctgatcataagtataacggaagtattacaaaagcttagcttctaaaagaagggaacaaaagcagcagattctattggctcattggcttctgaagtatttgtggtgcatgctttttaaaatatttttataaaagaaagattgagaacgagaaaaaaaagtgaaagaaagatactaagtaaaggtgagtttactctagagcctcgtaatatgaaatataaagaagtaaacagtactctatggacttcaaaaacctggtgtgctgcatgtactatttcttttagaacttttataaaaagaaacaaaataggatgttttaacatataactcgtgttacatacttggagatcgaaggaggtagttttgaaactccaatcatttcatcatattggcctaccagtgaggcaatgttgctcacatttctgttagccaaatttacatcaatttgattatttagactatgttttctttttcttgtaataaatactgacaaacatt

SEQ ID NO: 309768 - DNA, 4368 bp, Homo sapiens
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgta

SEQ ID NO: 309769 - DNA, 4259 bp, Homo sapiens
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatatgtctatgacctgcattgggagctctagagcgaccggcagcaccaggtgcacag

SEQ ID NO: 309770 - DNA, 4257 bp, Homo sapiens
gcggccgcggcggtgcagcagaggcgcctcgggcaggaggagggcggcttctgcgagggcagcctgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgta

SEQ ID NO: 309771 - DNA, 4074 bp, Homo sapiens
  misc_feature (183)..(183): n is a, c, g, or t
atgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttnctggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgta

SEQ ID NO: 309772 - DNA, 4311 bp, Homo sapiens
agcgggtaatccttcagctctggtggtaagggagatgcagtgagctcccggctgggagagagggttattttgcaaaactcccctggtaccgtgcccgcggaatattgcaggaggtctgtgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattagattagtctgta

SEQ ID NO: 309773 - DNA, 2943 bp, Homo sapiens
  misc_feature (183)..(183): n is a, c, g, or t
  misc_feature (2870)..(2870): n is a, c, g, or t
  misc_feature (2872)..(2872): n is a, c, g, or t
  misc_feature (2879)..(2879): n is a, c, g, or t
  misc_feature (2900)..(2900): n is a, c, g, or t
atgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttnctggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagagagaagncntaagagngactgtggagttggactggcnacaggggaaggaagtaaaatgtggttagaagtgtatccgtcga

SEQ ID NO: 309774 - DNA, 3209 bp, Homo sapiens
  misc_feature (3209)..(3209): n is a, c, g, or t
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggtatctaatatgagattttcaaagtttttgtgagctctgctgattatagagctggagggttctatttaattccgtttttccaatagaatatgtatatatgaaacaataaggagacaactacgcattttgttccattatagtcaggactcatgcgacttctccattacactcagtttcacagggtggggaaaagtagtcatcagaaacccatcaaaatttggactatgtgtccctaaatcatttagatagttgtctctgatgttagcaaatccagctgaataatatgaacatcagtgtctcctccatcccaaccctctggatttctcctagctctgtcttcattcaagaactctactcctcatccttgcttccagccctctgtttttatcttctgtccttaatcaagcccatggtgaccatcaccagaggcagtctcttttactgcatagtcaaagccctgtcttgtcttccctcccaaggatgcttctatgcttttgagaacatgctgacattttctggttgtgtccaaagcaacacattctgtgtgtgctcaggacaggggacaatagtctggaggggtgaatacagaaatgtccagatgccaatagctgcagaatatgcagcaatggaaagtatcagtatccatacaaagatttttcaagaaaacgaatgggctgagccaagtagctgagattgagaatgagttcatagactgtccaagatctttatcccaaaaacatttggattgtttattttcagtatttatcctctttccctactacctggatactccaaatttgcatatacttgtaatattaatatacagttcctttgcaatatttattttgttgcttcttagagaaacccaactaaatgagtttaaaaaatctgtgaaagggctgggcacagtggctcatgcctgtaatccagcactttgggaggctgaggtggacggatcacctgaggtcaggagttcaaaaccagcctggccaacatggtgaaaccctgtctctaccaaaaacacacaaaaaattggtcgagcatggtagtgtgtgcctgtagtcccagctactcgggaagctgagacaggcattccaagctgggcaacagaacan

SEQ ID NO: 309775 - DNA, 892 bp, Homo sapiens
agcgggtaatccttcagctctggtggtaagggagatgcagtgagctcccggctgggagagagggttattttgcaaaactcccctggtaccgtgcccgcggaatattgcaggaggtctgtgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaaggtaggccatgtcataaggtctatctagatgtttcaagatagaataataaacatgcctcttattcag

SEQ ID NO: 309776 - DNA, 760 bp, Homo sapiens
gatgtaattcatgactggcattcttcatgaccttttacattcaattgggttgacttatgcacattctgatagctgagtcttcctgatctggccttcagtgatgataaccaaagggcagaggagttttccctgagactgttttccagctgtcactaatgggccagtaagcagcaaggggagagacagggacattgaactagagtgatctctattcacttgtggccacctttgaaagcaacattggttgaagactgatgcatgtccaatataggtcagcaactaaatttataaatagatactttcccttttcagaataaaaaatgttcagaaacttgtagctatcatgaagaggacacccgacctcctaggtcatttaactttcagattttcacacaactaaagcactctaaggagacactctaaagacttaaacagccaatgtccaaaaaataaattaaaaaaatgaggcatgttagcacaactttccttattcctaaattcctttaaatttttaattataggagctggaagacctgaacaaatggggtcttaacatctttaatgtggctggatattctcacaatagacccctaacatgcatcatgtatgctatattccaggtgagtgaacaggagtgaatactggctttccaattggatggctctttatgattttttttttccatcttacttttctgatttaactttcctcgacttttggacatctacttatttatgttctaatccattttacaacacag

SEQ ID NO: 309777 - DNA, 332 bp, Homo sapiens
tggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaaggtaagagatgatctttttattcattaaagtgtgatcatgcagggagctccagctcccctca

SEQ ID NO: 309778 - DNA, 2943 bp, Homo sapiens
aagaagaatttggaataatcaagtcctataatttaaagcccggtggtgataaaatttcagttaccaatcaaaatagaaaagaatatgtacagctttatactgacttccttctgaacaaatccatctataagcagtttgctgcattttattatggatttcatagtgtgtgtgcttcaaatgccctaatgctgcttcgtccagaagaggttgaaattttggtctgtggaagtcctgacctggatatgcatgctctgcagagaagtactcagtatgatggctatgcaaaaacggacttaactataaaatacttttgggatgttgtgcttggatttcctcttgatcttcaaaagaagttgctacattttactacagggagtgacagagtacctgtaggagggatggctgatttgaactttaaaatctcaaagaatgaaacttctactaactgcttacctgtggcccatacctgcttcaatcaactttgccttcccccctacaagagcaaaaaggatctgaaacagaaattgatcattggaatttcaaattcagaaggttttggacttgagtaacctagaagacttgaaatataatcttttatatgtagcattcacttccctcttactgtgcctttagccttttcatgtttctgtctcaaaacactttgacaaagctcaccaactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtca

SEQ ID NO: 309779 - DNA, 1319 bp, Homo sapiens
  misc_feature (117)..(117): n is a, c, g, or t
tgacccttcggttgagatcttagtaggaccccgtcaatgacgaacgaaaacagctttttaatgtaggttaccacttataagcacaaaagaaacatgtataagaaaccagatttaagngttttaaataaaatgtaaacagtttttatttggtagagatgactcatggaaaaattgtgttgccagggggcttccgccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtca

SEQ ID NO: 309780 - DNA, 1152 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309781 - DNA, 834 bp, Homo sapiens
  misc_feature (783)..(783): n is a, c, g, or t
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctgaancctgcccttgccgaattccacacactgcgccgtactatttatcgagctcgt

SEQ ID NO: 309782 - DNA, 473 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagtgcatataacctacagcaagcgagcatggcagctggctgcacggactccggaggcgggagtacctggcttcaactcgtaactcagccagtcggcttctgtgtacctcaagtttcttcatctgtgaaatggagataatcgaatttagtattttgaaaagattgagttaatacatgttaaacacatgaa

SEQ ID NO: 309783 - DNA, 844 bp, Homo sapiens
cgccaacagcatggcggttgcatccccaggaagcaggcccgcagcgccaggagggggtttcctgaggacagaggcccttgtcctgattgtcgcagcaggccctgtcgatggacttaactgtgaaaatcaccctttcaggggtggatgcaaggacttctgagggcggagaagtagataccttcctggatagctgtggagccggggtcctgcatttccctctggcgtctctgctgactgagatgtgaagcagtcggcccatgtcccgagaagaggttggccacaactctgtgccacatcctcttcattttagaatccaggatgaaggatatgcccttatctgggcacttctccttgctgctgccatgtgaagaaggacatgtttgcttccccttctgcataattgactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacacgctaggaagaagaaccactatagtgttaactgtaatgggcagaatggccctttagtcacccttcctgtggcctaacacttggacactgtcacttaagaggcccctcacatctacgcaggaggtgattaaagaacattctaaattacctggtaatttgggggtgtaagtacatgaaagcatttttaaaattctaatttgtatgtttttggtggactttgtgtaatttctttctt

SEQ ID NO: 309784 - DNA, 489 bp, Homo sapiens
acaccaataggtttaaattgaacattagggactgaggacttctgtgcccatggtcagagaaggcaggaagaacaggcatttgctggcagcaggtgccacagtgaaccagcctagcggttcctctgccccatgctgtggttgtagggatagtagggaaggatttgtgcataatccccccttcacctcttgacacgattcaaagtccaaagcctcatcatcaccttctcttctgccagtcttaagttcttctactggaagtttaaccgatttcattcttattaacaaccattgttattttacagtgcatataacctacagcaagcgagcatggcagctggctgcacggactccggaggcgggagtacctggcttcaactcgtaactcagccagtcggcttctgtgtacctcaagtttcttcatctgtgaaatggagataatcgaatttagtattttgaaaagattgagttaatacatgttaaacacatgaa

SEQ ID NO: 309785 - DNA, 2325 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaattttaagtttgaagttctttgaatgacctttcagagtaatttcagaacaccagcagcatcttaaacctgagtctaatttctttcttgttaattaggcaccagataatctttataaaatggttcttaaaagtctagtaataggagtcttaatggcatattgatgattaccacatggttttttataaaaacctgcctgccccttagtgaaaggtacctgtaactcacagttcatttagacactaatttcctttgctgtcatgattggtagacttcacttaccctatattaattttgaaaaaaggtggaattttattatatatgaaggaatagtttgtatcttaccatagcacagaacagtgacctcttgctcaggataagatgtggtgatttgaaaatactcaatagtagccttgcagtgatatctctctctctctctctctgcaaatctaaattttattctctggtatttcctccaagtttttattttgaaaattttcagactacagaaggactaagcatagtacaatatacacctgtatatccttcacttagatcaccagttatcaatatattggcacctttgctttttcttgttctctcacacaggcacacacaatgcatatatgcacacacacatagatctgttttttgttgagtcatttaagattgttagggaattatgataaatcagccatagtactttagcaggtatcttctgagtaaggacatgtgttcctttataaccataatgcagttgtcagactcaataaagttaacatttataacaatactaccatctaatacatagtttactttcagatttccccaggtgttctaataatgagttcttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagtctctatggatttgtctttcctggacatttcatataaatataatcatatgatgtgtgatgtacgtgactggcttct

SEQ ID NO: 309786 - DNA, 1228 bp, Homo sapiens
  misc_feature (1007)..(1007): n is a, c, g, or t
  misc_feature (1012)..(1012): n is a, c, g, or t
  misc_feature (1017)..(1017): n is a, c, g, or t
  misc_feature (1021)..(1021): n is a, c, g, or t
  misc_feature (1024)..(1024): n is a, c, g, or t
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccccggggaccanaaacngttangtgnctnaacgggctgttggtatgcgtgggccaattcctttttttaaagtagagctaattggatttgcgggcgaaactttatagcacaaaaaggcgcgcattcctagggcggaaggcacattatagggcacgtaataataaaacggcagagaacagaattggtctgtgtcgtcaacacattctatgtcgtgtagaatgctagagcattgta

SEQ ID NO: 309787 - DNA, 973 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggatttttcccttgccgtaacctgtaattatgttctgccctattggggcggaaattcaaaggtattgccaactccatctagaacctggtaggtgttttccccgggacaaaaacc

SEQ ID NO: 309788 - DNA, 1304 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcaggtacgagtggcgcctggccagctcggacatgagaagtggcggccctagcctcggcgacaggcagtcgcggcgttggagccaggggaggcttctgcccgcggtcgagttcgtctctgttctccttgcacctcccggggcctctccacaccagcggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309789 - DNA, 1608 bp, Homo sapiens
cgccaacagcatggcggttgcatccccaggaagcaggcccgcagcgccaggagggggtttcctgaggacagaggcccttgtcctgattgtcgcagcaggccctgtcgatggacttaactgtgaaaatcaccctttcaggggtggatgcaaggacttctgagggcggagaagtagataccttcctggatagctgtggagccggggtcctgcatttccctctggcgtctctgctgactgagatgtgaagcagtcggcccatgtcccgagaagaggttggccacaactctgtgccacatcctcttcattttagaatccaggatgaaggatatgcccttatctgggcacttctccttgctgctgccatgtgaagaaggacatgtttgcttccccttctgcataattgactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309790 - DNA, 1076 bp, Homo sapiens
cagggaggtcgggagatggacggaaactgctggggatgtgagaagcctggggcactaactggagttgttattgacttgggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309791 - DNA, 1095 bp, Homo sapiens
cgggaccacagccggggaggcggggtccttctctggggcggtcgcgttggcagcggatgcgggaagccggactctgggcgtcatgtactacaagtttagtggcttcacgcagaagttggcagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgtttggtttgtttatgaaatgcatatggcttgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309792 - DNA, 1099 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagattgtcagagctcattcgacagttaaagccattgtttaaagaaacggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaa

SEQ ID NO: 309793 - DNA, 633 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactgtgcatataacctacagcaagcgagcatggcagctggctgcacggactccggaggcgggagtacctggcttcaactcgtaactcagccagtcggcttctgtgtacctcaagtttcttcatctgtgaaatggagataatcgaatttagtattttgaaaagattgagttaatacatgttaaacacatgaa

SEQ ID NO: 309794 - DNA, 900 bp, Homo sapiens
cgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttggccagcagggcttcagtgatggtgatacagatgtgcggcactgctgtgtcgtggactcacctcgtcccagactgaggaccaagactgacacagactctcttctgtttcccttatctcctttccaaagtaagtctgtgaatctaccctggtcctttccttctatgtctaatgaatgtctttctcctagtgtagtggaggaagtacaaattttgaagttctagaacataaagtctcagcatggccatgatctaaatgaacataggctggttactaaatctcccaaactcatttcttcatctacagtcacctccctgtatccctgaacacctgggtattgggagatgttgggcccacagtaggtactcctccaggggcagctcttcttggtccatatcctgcccatctgctcttcagccttcgtggtcctaaaaacatgtacttatcctttatttccagctttaagctggaaaactagttccttctagaagttacactaatacaacacctcaatgtgcccaaaatctaattcatcatt

SEQ ID NO: 309795 - DNA, 3166 bp, Homo sapiens
ggcacgaggggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309796 - DNA, 3125 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309797 - DNA, 2972 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309798 - DNA, 284 bp, Homo sapiens
gattttgcctaggacaccctcagtctcaactgcatacgtcatccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtggaagtgtggcagggcgcaatgtggtacagggggtggcttggtcacaacagga

SEQ ID NO: 309799 - DNA, 2842 bp, Homo sapiens
tggaagcagcgtaaaggatggacaggaatgcagaggtaggcaggaggaccagcagtgtgactgctgaaacccaggggagggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309800 - DNA, 3104 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309801 - DNA, 3207 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309802 - DNA, 2837 bp, Homo sapiens
  misc_feature (23)..(23): n is a, c, g, or t
ttttttgtcagccccgcagttantgcatatggcgaaccgcgccctcgggcgacgccgggggcgccgtcgagactagccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309803 - DNA, 2966 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccattcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309804 - DNA, 2395 bp, Homo sapiens
  misc_feature (2227)..(2227): n is a, c, g, or t
  misc_feature (2280)..(2280): n is a, c, g, or t
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagccccccagggnaacccaaccttaaacccacccgaacggggccccaagggcccacaaaggggggnggttttcccccaaagggaacggccctttaaagggccccccaatgggggccttggtgccgaggaaatttccgttcccggaaacgctttccccaagggaaccaaaagggaatggggg

SEQ ID NO: 309805 - DNA, 3083 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309806 - DNA, 2030 bp, Homo sapiens
aggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309807 - DNA, 4222 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttgtagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309808 - DNA, 3127 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttaaaaaaaaaaaaaaaaaaaaaaagcgggcgcccgggcgccgtggcgccgtgcagtggagggccccgggcgcccggcccttggttctgggggccacgccgcccgcttgggggccccaggaaacagccccagggaagaaatcatttgcaagaagggtgggagaccgtgaggggctcgtaagccgggaggggtggcccctgtgttgtgggcatttccccaagcaggtgtaccccgtgctgggcaccgtgtctctgtgggacagatatttgcccccagaaatgtgttgcgcgtcccgtccacgtgttgctctgacctgggaggccccatcccacaactttgtgtacccacctctgtggaggcctatacaggagatcctcctctcaaaacgcggcggatttctcccaaaaattctccttcttcagaacagacagacgaagggagtgggacacacaaaaattctcccaagaatttctgagaagacccttaccgggaagagaattccccgcgtgggcgcgtggcgaccacaggggctcctcatatgaagttcgccccacagcgagaggttgggtgcgaacacactccttttcccggcggcgacaaagggggttctcctaaacgagttcacctgtgagaaagagaaaactcccacatcgggggttacaaaaaaagccacctctttgggagttggccccccccctcggctgggcaacaaacacgtccttcggggcgccccaagagggcactccgcgtgttcgccaccagtttccaaggcgggttttacacctccacgggcgagagaaaaaaggcctctttattacgaggggcccaggcggaggtcgtgttgcgggccaacaagagcttctcgtgtacaacgcgaagatgtgtacatcccccacgctggttccccccaacgagaagatactcccccagttggggagaggaaaagccccttacagattgtgccctcatgtgttcgcgaaaagactcttccgggaactcagcggaggagac

SEQ ID NO: 309809 - DNA, 1901 bp, Homo sapiens
gattttgcctaggacaccctcagtctcaactgcatacgtcatccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309810 - DNA, 2512 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttaaaaaaaaaaaaaaaaaaaaaaaaaaaaaaaaaaaaaaaaaaaaaaaaaaaaaaagagagagaggggcgggcgcgcgcgccaaaaagaatatctcccccgcggggggcgccccagtttccgcccgcgcgcccccacgtttttgggaccaggggggcgcccccataggagagagacgcccatatatcaaacacagcgcagcgagcgaggagccgcgccgcgcagtttacaacacacacggccgcggagacgggggaacacaccgctggacagagcgaggggacaactcggggggaggaggaaaacccccctcctcggggggggggccacacaaggcgggcaaacaactaatccccccagggaaatatcaagccccccgaggcaaaaataagcctt

SEQ ID NO: 309811 - DNA, 3084 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309812 - DNA, 3150 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309813 - DNA, 2836 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacaggccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309814 - DNA, 2019 bp, Homo sapiens
  misc_feature (1971)..(1971): n is a, c, g, or t
  misc_feature (1994)..(1994): n is a, c, g, or t
  misc_feature (2010)..(2010): n is a, c, g, or t
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagccccaactacatnttcctgccggattccagctgagncggtctacataaccanttgtttagc

SEQ ID NO: 309815 - DNA, 2142 bp, Homo sapiens
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagttgccggtggacagcatggccgtgccagcctcccacactgaggccaggtctaccccccatcataccagcccccaggaccactaccccacggccagccagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaa

SEQ ID NO: 309816 - DNA, 1444 bp, Homo sapiens
  misc_feature (1444)..(1444): n is a, c, g, or t
gtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggaccagacctgaagcagtacctgggatgactgtgggagcctctccaacctgccccacgtggaactgtctgttccagctggtccgtggctggcttcctgccaccgggagtggtaccccggactcagcccgaactgtctcacgagaggggcgcccacgcgctgatttgcgggcgggcagtttccccaaattcctggggggcacttggtcgcccgcagtcgtgggccgccccccagttgggggggggtttaaagaggccctgccggggagacctcttccggggcgttgctcccacggtgcttggggtctcan

SEQ ID NO: 309817 - DNA, 450 bp, Homo sapiens
ggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgc

SEQ ID NO: 309818 - DNA, 1807 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309819 - DNA, 1218 bp, Homo sapiens
actctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactaactaactaactaactctaactaactaactatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309820 - DNA, 325 bp, Homo sapiens
gagagagagagagagagagagagagagagagagagagagagagagagagagagagcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309821 - DNA, 2236 bp, Homo sapiens
  misc_feature (1823)..(1823): n is a, c, g, or t
  misc_feature (1828)..(1828): n is a, c, g, or t
  misc_feature (1831)..(1831): n is a, c, g, or t
  misc_feature (1852)..(1852): n is a, c, g, or t
  misc_feature (1856)..(1856): n is a, c, g, or t
  misc_feature (1860)..(1860): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagcaaaaaaaaaaaaaaaanaaaanaanaaaaaaaaaaaaaaacaacanacanaaancaacaaaacaaaaaacaaaaggggggggggggcgcaaaaaaaatacccccggggaggagcccaacatatccgcgcacaccaagtttgtggcaaagaaggaggggccccaatagaggagagacgacacaaacaacaagagacgagcaggcgggcgaataaaacaagcaggagaaggagcaaaaaagcgcacacgggaatactgtgagaggagcagccccacacaaggggggggggacgacacaaaggggagaagaacccaccaccacaagagacaagaacccccagggggaacatacaaaagaaaagaacaaaagaggagaaaccaacccaaacgccgccggaagaagaacgccaccgagagcacaagcaaattacg

SEQ ID NO: 309822 - DNA, 2001 bp, Homo sapiens
  misc_feature (1823)..(1823): n is a, c, g, or t
  misc_feature (1828)..(1828): n is a, c, g, or t
  misc_feature (1831)..(1831): n is a, c, g, or t
  misc_feature (1876)..(1877): n is a, c, g, or t
  misc_feature (1885)..(1885): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagcaaaaaaaaaaaaaaaanaaaanaanaaaaaaaaaaaaaaactcgagactagttctctttttttttttttnntttttttnttttttttttttttatacacaaataaggggttttaattatgtggatttgcccaccaaattttgaaaatgtttgccttaaaaccaagatatcggggtttaaaccatgaaagcttttg

SEQ ID NO: 309823 - DNA, 1761 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgttgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309824 - DNA, 1752 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaatacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309825 - DNA, 1611 bp, Homo sapiens
  misc_feature (1539)..(1539): n is a, c, g, or t
  misc_feature (1544)..(1544): n is a, c, g, or t
  misc_feature (1550)..(1550): n is a, c, g, or t
  misc_feature (1553)..(1554): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttggntctgngaagcngannttgtttccccatgttgggttttcacactcgcttttgtggaaaatgggggccccaatg

SEQ ID NO: 309826 - DNA, 1469 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaagcttgttcttgtgaaggatcgacttggggccctgcggaaccgggtgtgggggagactctgccccgaaccgt

SEQ ID NO: 309827 - DNA, 1401 bp, Homo sapiens
  misc_feature (1364)..(1364): n is a, c, g, or t
  misc_feature (1380)..(1380): n is a, c, g, or t
  misc_feature (1393)..(1393): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctacccttcctttccaaggttggccttaagganaatttttaacggaaanaaattccaattanttcttttg

SEQ ID NO: 309828 - DNA, 1777 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctcttgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309829 - DNA, 1753 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309830 - DNA, 1841 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtctatagaagaggagggaaaaacacacctaggaatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309831 - DNA, 1713 bp, Homo sapiens
gcttgctggttttagtggagcacttccagtaactttgtgagaaagggtacaagggagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309832 - DNA, 1870 bp, Homo sapiens
cctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309833 - DNA, 1790 bp, Homo sapiens
  misc_feature (28)..(28): n is a, c, g, or t
  misc_feature (49)..(49): n is a, c, g, or t
  misc_feature (56)..(56): n is a, c, g, or t
  misc_feature (95)..(95): n is a, c, g, or t
  misc_feature (116)..(116): n is a, c, g, or t
  misc_feature (137)..(137): n is a, c, g, or t
  misc_feature (158)..(158): n is a, c, g, or t
  misc_feature (197)..(197): n is a, c, g, or t
  misc_feature (221)..(221): n is a, c, g, or t
ccaaacccctgtttgaaaaaaccttttnccccccaaaaacccccccccntccaaanaaaacctaacctccccttcggtcctttccctgggatccncccgggggggttgaacccctnccttggccttggttgggaaanccttgggggcccaaaactttnacctcctggggcaacccaaaaaatcctccccctaatttncccgaggaaccccccaccaaattnctcccctattgttccttcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309834 - DNA, 1840 bp, Homo sapiens
  misc_feature (357)..(358): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatctcttgttacaacnngaatcaatcatctcactctacccacccaccaccaccacacacacccccaactacacacacccaccaacacacccactcccacaccaatccaaccaacacatcaccccatcatcccaccacacctctctccatacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309835 - DNA, 1334 bp, Homo sapiens
gagctcggtaccgggtcagtacggatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309836 - DNA, 1273 bp, Homo sapiens
tggcacgaggcaaatgctccctatgtgctcatcggaacatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcagttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaaataatgcctctgtctagcatgccaacaagaatgcattgatattgtgaacatttgtgatatatgtattaataaatagagcaattacaagca

SEQ ID NO: 309837 - DNA, 1221 bp, Homo sapiens
  misc_feature (386)..(386): n is a, c, g, or t
  misc_feature (390)..(390): n is a, c, g, or t
  misc_feature (394)..(394): n is a, c, g, or t
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgagaaaacaaaacaaaaaccaataaacagaacccaaaaaccaaacanacanaaancaacaaaacaaaaaaagaaaacaacaaaaaacaaaacaccaaccaaataacaaacacaaacatcaaaacagaacaaacaaaaggcaataaaaaaaaataaatccaaacaagtaaaccataatatcaatcagcatgtcagaatcaatcagaatagaacataacaacaccaatcataatcaccatctcacaacaaccctaagactcagaagtatacctccgcctcaatcaatgaatcaagagtttaaagagtataagatgagatatccccaaaaaactaactactaaggcgaaactaagaagttcgtcactcaaagttgaaacccattaagtagttaaatgtagtacagtctaattaaaactcaaagtagatgcatagttaataactaaagcatagttgaagtacagacttctaatggaggtaatactttatgtaagtaatatacgtcataaactgacctcgagttttgacatatagtgctgaactaagctaatgccgaatcaagtactagttcctcgatgtacaaaaccactgtgtgcaatgactattgaaaaaagaaaggtgtggttgagttaacacattctcttggccgagaaaagaactgttaatgaagtaagaccgcgatgttgggactactaggaaaatcaggtggcggtgcggtcgtaaagggagtgccccattgaagaagatagaatccttctgtaacaaaaaagccggagtgcccagacgtccgcggagtctcaggagccggcgcatagatgcgggtggaagtggtatctccgctagggagcgaggacgctccgtgtgggggccttggtatcgataaggg

SEQ ID NO: 309838 - DNA, 409 bp, Homo sapiens
agcggctttcccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcgggactgcaggatggcagggtgcgggtcggggctgctggaaccctagacctcgctccgcgcaggctgcaaggggctgcggagtgtcggtgactgcaggttgtcgaccttcca

SEQ ID NO: 309839 - DNA, 584 bp, Homo sapiens
ttttgtgtaaataagagtaaatgaggtccgagtacaagtcggagattttcttctgagttcaggcttaagcttcagtgcggggatattggtgaattttgctcagcagcatcacaggcccttcctttgtccttgtttcattgttctcaattgcaccccacatagaaaataatcattagaggaaatgaatggactttttcaagttttccacaaaagtgccatgaactagaaaaggaaaattctaaaattacttattactagaaatatatgatgtagtaacatctttaattactactgctaatattaacaaggaagaaaactattttttttataaattacttttctctcaaaaataaaatgactttgaggataaactatttaaatctaacacaggaaagctatttttttccccaagacaaatacctattttttaaaaaagacacacccagatcttggtttctcaatactactccccaagaaagggaaccaaagctccttaaaggaatgcctgattctaggactgggacaaagaatctacaagatgaagctggagaatgtgatggtgccagaaaggaggtgcaaaaaaa

SEQ ID NO: 309840 - DNA, 938 bp, Homo sapiens
tatccttcagggcaattgtgagaggtaagcaggctaacacatggtaaatactcagaacaatgcctgttagggcaaacactatagaagtacttgttacttggtgtgcgtaagagggcaggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccaggctgggcaacagagcgagactctgtctcaaaa

SEQ ID NO: 309841 - DNA, 141 bp, Homo sapiens
aatgtgctcctctcctggtatctgcttatctcctggaatctgagacacaacatagagcaacccccaggccagccatgactggagcctcccaagttgcagggaagggccctgtactaggccaagaacctatcctgaccagtt

SEQ ID NO: 309842 - DNA, 823 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309843 - DNA, 819 bp, Homo sapiens
  misc_feature (1)..(5): n is a, c, g, or t
  misc_feature (35)..(35): n is a, c, g, or t
  misc_feature (44)..(44): n is a, c, g, or t
  misc_feature (58)..(61): n is a, c, g, or t
nnnnnaaaaaaaaaaaaaaaaaaaaaaaaaaaaanaaaaaaaanaaaaaaaaaaaaannnnttcagaaatgcagaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgaacacacgaagcggaaagcaagccaacgctaaaaactcggcttttttgccttcacggtg

SEQ ID NO: 309844 - DNA, 562 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaaggtccaatcaacctcttacctaccggggtagaattgtctggtgctgttattcttctagggtattaccttttaatctctttgtggaggttactgcacccaatcgtatcccattttagaactagattttttattagcct

SEQ ID NO: 309845 - DNA, 491 bp, Homo sapiens
cgacaaagctggacctcaccgtcgtggtgtgcgcgcttcttagaattaatgaatccctccgggatggatggtaattctatgtatcatgcttatcgagtatcgtcgtactcgtagaggttgaccgctatccaattctgtgctattgtgagtgttattaatcgcgcacacatgacagtcgtcttacaatgttttgattgggataatgctgacgaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggtgaggtggctttcgatggattgttgctgctctgcattactcagtgggtgcttgtttgatctcttggttcttaaatgtttc

SEQ ID NO: 309846 - DNA, 1340 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309847 - DNA, 1093 bp, Homo sapiens
  misc_feature (22)..(22): n is a, c, g, or t
  misc_feature (29)..(29): n is a, c, g, or t
  misc_feature (34)..(34): n is a, c, g, or t
  misc_feature (36)..(36): n is a, c, g, or t
aagggctcaggtacgaggccgngtgtgantcggncnaggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309848 - DNA, 1020 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309849 - DNA, 1577 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgagagtcactgtgttgttatttattaggtgtgctatttcattagctgcttaatcctttgagtcctaagactctttggagacgctatgaagctccaatgtgggcccttttaagagcttttcttgcatacaaaccttttctccctctactttgacttctctccaggcatctcatctttaatagatctttgactaattatagctaaaaactctcagagaatacagcataataaatagccagt

SEQ ID NO: 309850 - DNA, 1398 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgaacacacgaagcggaaagcaagccaacgctaaaaactcggcttttttgccttcacggtg

SEQ ID NO: 309851 - DNA, 1572 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatgaaaaaaacaaaaaaacaaacaaaaaaaaaaaaaaaaaaaaaaaaaaacaaaacaaaaaaaaagacaaacaaaaaaaaaaaaataacaacaaagaaaagagaacaaaaaaaaaaaaaacaaagagaggaggcgggcggcggcgacgcgaacgccaccccaccccgctcgcggggcggcgctccggctagccgccccgacccgctcggtcgcacacacgagcgggcggcccccgt

SEQ ID NO: 309852 - DNA, 1432 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccagttgctctgtaaggtgatattgtgatcattttatagaggagaaaacaaaggctcaaaggatttacagaagaagggatcaagttgagattcaaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309853 - DNA, 1165 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcatttgactagcttcccaagtggggggcagatttctggtaggcccgcgtaacggcgatggtt

SEQ ID NO: 309854 - DNA, 755 bp, Homo sapiens
caaccggaccctcgacccgtcccctttcccatctttatccctccatatacacctccttacaagcgacgaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309855 - DNA, 1195 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccagaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 309856 - DNA, 856 bp, Homo sapiens
gtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggccgagttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcagctcttctgcatcttacacttgctcctcagtttccatctttggcccccttctacccaaaccttaacctccttcttgtaagaaacttggagcagtgacaggaattgcagagaaaactgcttttttttttttttttttttagcgtttgaaattaaaatgtttagtaataaattatttgtggattcattcagcataggtcttaatgagttcctactacatggctagaattgtactacatacaggagattcggtggtgataatcagtcaagaaaattacaatataataaaaacagactaaaaaaagaaagtcttatctgcctgaaaaaaaaagataaagttaaaaaaaaagaatgaaggtcagctagtgagatgtgagaggcatctaagatagctggtagattttt

SEQ ID NO: 309857 - DNA, 505 bp, Homo sapiens
agctgcagatgatcgagattggtcgatcactgtactccagcctgggcgaaagagtgagaatccatctcaaaaaaaaaagagaatggcttgttgacaaatcatgcattgaagctgtgataatccatttgtcttttctcttggctccacatacaggtggtgtgcagatcctgccttactaaactgtttgaagcaaaaaaacaccgtggtcaggttggttttactacttaatcctttctccctcatccacaagttgtgtttcctaaagtagttgatttgttgagcatagttcctagtctgctttcttcattctcactcagtacagtgatcgaccaatctgttccaggtctttgccagaaatcagattcttcctacaaatgtttttttcttggagtggctgtccttttcctcttagattattagaagccagcagttcctcttaagagaatcttttttaagctagcacatacctgtcaaaaggcaaagttggaggaggcatcatggagct

SEQ ID NO: 309858 - DNA, 704 bp, Homo sapiens
ggaagctgaggcaggagaattgcttgaatccgggaggtggaggttgcagcaagccaagatcgcaccattgctctccagcctgggcaacaagagcgaaactctgtctcaaaaaaaaaaaaaggaaagaacctcagttgaatgaatctacgttgtttattgtcttggaacaatgaaattaaagtctaatttgtaaactgaatagcaaatacataattcatcttgcagaatttctttttcaggcctaccccttgctcaggttcaagaagacagtgaagaggctcattccgcatcttctttctttgcagaaatttctcaatatacaagtgggtgagtaacaatccattagttcagtctattgtaataattccatttcttgttcagttgtttggcaacgtaacatttgaatcatttaaattccagttaaaaataatcagttattgcctaggttttcttgtagggtttttatggtttaggtcttacatttaaatctttaatccatcttgagttaatttttatgtaaggtgtaaggaaggggtgtagtttcagttttctgcatatggctagacagttttcccaacaccatttattaaatagggagtcctttccccattgcttgtttttgtcaggtttgtcaaagatcacatggttgtagatgtgtggtgttatttctgaggcctctgttctgttccattggtctatatatc

SEQ ID NO: 309859 - DNA, 3532 bp, Homo sapiens
ttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcaatcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaa

SEQ ID NO: 309860 - DNA, 3478 bp, Homo sapiens
ttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcaatcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaa

SEQ ID NO: 309861 - DNA, 1705 bp, Homo sapiens
cctttacaatcagctcgtaccctgcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcaatcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaa

SEQ ID NO: 309862 - DNA, 3736 bp, Homo sapiens
  misc_feature (3535)..(3535): n is a, c, g, or t
ttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcaatcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaaaanaaaaaaaaaaaaaaaaaacaaaaaaaataaaaaaaaaaataaaaaaaaaaaaaaaaaataaataataataaataataaaaaaaaaataattattatatctttttggccccctttgccccatttttttttaattttgaaaagatttttttttgcgcccaaattggggctcttttgccaacttcccccttttggggggcgttt

SEQ ID NO: 309863 - DNA, 431 bp, Homo sapiens
atgtccatttttctctcataggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggtaaggttttcatctgggtgttgactgtgaataacattttgccatgctttactggcaaaattaattattcttgtgattatataatgtatttctaggttctgtgttatgttttttgttgaatgattatctgttttttaatggatactgtttaaacaaggaaaggtagaataagctgtgaaaaagataattaggtgaaactacctaattatcaactgctctacagatatgcagggagaccacttggacctgcttttccctc

SEQ ID NO: 309864 - DNA, 1833 bp, Homo sapiens
agcggagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 309865 - DNA, 1807 bp, Homo sapiens
taaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 309866 - DNA, 1717 bp, Homo sapiens
tgcgcgcgcctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 309867 - DNA, 1621 bp, Homo sapiens
agcggagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccggaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 309868 - DNA, 1778 bp, Homo sapiens
agcggagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccgtttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactca

SEQ ID NO: 309869 - DNA, 1233 bp, Homo sapiens
taaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgctttaagttgcatgatctttctgcaggaaatagtcactcatcccactccacataaggggtttagtaagagaagtctgtctatctgatgatggatagggggcaaatctttttcccctttctgttaatagtcatcacatttctatgccaaacaggaacgatccataactttagtcttaatgtacacattgcattttgataaaattaatttggttgtttcctttgagtgtgattctggccg

SEQ ID NO: 309870 - DNA, 636 bp, Homo sapiens
tcctttcaattctggacctggaagcagatttccttccagaggtagaaatgttcttcctacccagcaattgtcagcatccggggtggcggagagggggccgctctgccatggactctccgtcacccagcttgtccctctccttccccaggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaccagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttt

SEQ ID NO: 309871 - DNA, 559 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309872 - DNA, 735 bp, Homo sapiens
ggcacgaggtgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctggggggactgggggacacagcagcagaggccaagaagctggctgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309873 - DNA, 825 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaatgtgggccgcctcggcccagttgactttagactttagcaaagttatgcatgcggcccaattggagctaactgggccaattgccctatatgagggggattacaataaatggccggcgtttacaagcaggggactgggaaaccctggcgtaccaactaataacttggggaaatccccttttcaagggggggaataaaaaaaggccgaccccccgcccttcaacaatgggaacctgatggggag

SEQ ID NO: 309874 - DNA, 839 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaagttgtgtggggcggccgggccttggaaaaagttttaaaacccatcgttggggggggggccccaagtgggacgggagcacgtggccagacagtggtgccaagagaaacccgggggcacgacccgacgggcggggttccccaccaattaaaaaccccgcgcggggacaaccgaccgttttggacacatcaaagagagagtccgggaggccataggggctccatcaggggagtccaggaagcgaaataatag

SEQ ID NO: 309875 - DNA, 900 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaaaaaaaaaaaaaaaaaaaaaaaaagggggggggcaaaaaataccccgccgggggggcacacaataaacgcacacccacatttttgtttgataacgaggggacccatagagggggctataaaataaaggacgaccagcggccgccactaaacagcggggtgtcgggaaaaaacggcagcgggcaacatggagaagaacaaagtcggggggggacgtgtggacaaactcacggagagtaggcccgggacaatacaacgggacgctatggtgcaaccgcgaatcacggaggaagggaacgatgattgaaattag

SEQ ID NO: 309876 - DNA, 512 bp, Homo sapiens
gacaaacagcatagtgttgacttgaggttttcaaagcagggcccacccttggagctctgtacagtgacacatctccccatcgacagctctgcagtgggcctggggttttcctgcccattactctcctcccagcatgtcagcttgttcagaacagtgatttctgtcttttggggtcactgctgattccccggcctctagaatagaggttggcacacagcaggtacctgtggatattggttgaacaaacaggtgggcaaagtgaggaagataagaagtccatccgttcagtttccccactgcggagggaataacactgtctttccacaggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309877 - DNA, 998 bp, Homo sapiens
  misc_feature (5)..(5): n is a, c, g, or t
  misc_feature (998)..(998): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaactcgagtttttttttttttttttttgggaacgtttggaaaattttttttttaaaacacaggaccaaaaaagctttggggttttccaaaccgggggaatctccaccgaaaaatggtaagcagcgcccccatggagaagccccaagtaggataaacacccctcgagtgcgcaacgggcgctctaaaaggggcggtgggcaacccctgaggtgtggaacgagaaacccgagaccctcctagagggaggaacaaatgccaccgtggggggacgccggccatttggaaaccgggggcccccaaacggaaaaaggggaatcccggaaaaactccaccttagggggtgggacgccttacgaaattccaacaaatatttacactttttaaaacgactgtttggagaggaattctaacaagtttccaagattcn

SEQ ID NO: 309878 - DNA, 925 bp, Homo sapiens
  misc_feature (5)..(5): n is a, c, g, or t
  misc_feature (624)..(624): n is a, c, g, or t
  misc_feature (633)..(634): n is a, c, g, or t
  misc_feature (767)..(767): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaaaaaaaaaaaaaaaaaaaaaaaaaaaggggggggnaaaaaattnncccgggggggccaaattagcgtaccccggttttttggttacaaagggggtgcccctaggggaggaggctataataaagaaaaaggagcgggggcgcggtttaacaaaccgtggtgagcgtgggaaaagtcggntagctgggcaagctgggggaaggagaccctcacttctcggggggcgagacagtctggggcgccatacccgaggaagattaaaggtccgagcaatttacccttgaggtcttagggtgtaccacgcgtatctgcctgaaatggccaggattgtgaaattg

SEQ ID NO: 309879 - DNA, 845 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaacaaaaaaaaaaaaaaaaaaaaaaaaaaaaaaaaaaaaaaaaaaaaaaaaagaaaacaaaaaaaaaaaaaaaagaggggcggcgcagcggcgcaagaagagaaacctcctccggcgagggggcggcccacaaacgaagctagcgcgcaccgcccgaggttttgtatgttcaaaaagagagggcgcccccactaaagagagggcggactaataataacacaaaggagaagccgacggcgcggcggaaaaaaaaaagggtggcaggggggagaaccacgt

SEQ ID NO: 309880 - DNA, 895 bp, Homo sapiens
  misc_feature (5)..(5): n is a, c, g, or t
  misc_feature (594)..(594): n is a, c, g, or t
  misc_feature (603)..(604): n is a, c, g, or t
  misc_feature (737)..(737): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaacaaaaaaaaaaaaaaaagagggggggggggnaaaaaattnncccgggggggccaaattagcgtaccccggttttttggttacaaagggggtgcccctaggggaggaggctataataaagaaaaaggagcgggggcgcggtttaacaaaccgtggtgagcgtgggaaaagtcggntagctgggcaagctgggggaaggagaccctcacttctcggggggcgagacagtctggggcgccatacccgaggaagattaaaggtccgagcaatttacccttgaggtcttagggtgtaccacgcgtatctgcctgaaatggccaggattgtgaaattg

SEQ ID NO: 309881 - DNA, 1360 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaaaaaaaaaaaaaacaaaaaaaaaaaaaaaagagggggggggcgccacccacaaaaatcccccgagaggggcacccacgtccccgagcaaccccgaattttggtgtcacaaagagggggccccacaaaggggaggggcccatatacaacaccgaccagggggcgcgccgctcaacaccaccacagcgcgtcgcacggggcacaacacgcagctcccgcgggacacctcggggagagaaggcagccctcaacaccgagcgaggggaagcaaacacaccgtggggcacacacacaccccacaagagacctttacgcgcgcggagggataaaaaacactccaacgcgccggtacaagcggtggtcgcaccccacggacgacacactcgcgaccgccgatacacagcttttgctcaccggacatatatgttgacaccccttctcacgcgggagtacaataataataaactagcgcgccacacgatcacgccgcgctctacccacgtccctccaccgccacgcacgagccgctgtacactgtgcggcacctatgactgtggttttttgtcgtgttcggtaatctaacactcatgagctctccacagttacttcgcactggttagttatatgcttcagttgcgactaggtcatgttatcgtagttgagcaacatgacaacggagcagccacaaaggctgcaaggatagaatctgagacttgtccttctatgctattactgttaagcgcggccaccaaactaggtggctgtgcgccgcc

SEQ ID NO: 309882 - DNA, 838 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaagttttggggggtttgggccttagaaaaagtttttaaacccatttggttgggggggggggccccagtatagttatacggttgaacctgtggctaatggcggtgtttccatagggaagaactcgggcggatatgacatataggtgcgtgggctttcttacccatttaaaaaaggcggcggggggggagaacagaagctgtttttgagaacaaatttccagaaggggggcttagagagggccaatcacgga

SEQ ID NO: 309883 - DNA, 750 bp, Homo sapiens
  misc_feature (5)..(5): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaagaaaaaaaaacgtggggggtttttttttggggggggggaaaaaagggtattgaaggggggcgagggtgttaaaggtgtttggcaagcccttttttttgaaaagggggagaaagggggggaccaaaagagggggggaattatttagaaaagaggggacgga

SEQ ID NO: 309884 - DNA, 939 bp, Homo sapiens
  misc_feature (5)..(5): n is a, c, g, or t
  misc_feature (638)..(638): n is a, c, g, or t
  misc_feature (647)..(648): n is a, c, g, or t
  misc_feature (781)..(781): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaaaaaaaaaaaaaaaaaaaaaaaaaaaaaaaaaaaaaaaaaaaaaaaaaaaaaaaaaaaaaaaaaggggggggnaaaaaattnncccgggggggccaaattagcgtaccccggttttttggttacaaagggggtgcccctaggggaggaggctataataaagaaaaaggagcgggggcgcggtttaacaaaccgtggtgagcgtgggaaaagtcggntagctgggcaagctgggggaaggagaccctcacttctcggggggcgagacagtctggggcgccatacccgaggaagattaaaggtccgagcaatttacccttgaggtcttagggtgtaccacgcgtatctgcctgaaatggccaggattgtgaaattg

SEQ ID NO: 309885 - DNA, 665 bp, Homo sapiens
  misc_feature (5)..(5): n is a, c, g, or t
  misc_feature (570)..(570): n is a, c, g, or t
  misc_feature (573)..(574): n is a, c, g, or t
  misc_feature (577)..(578): n is a, c, g, or t
ggccncctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaaaaaaaaatatncanntcnncccaaattcaactttactaaggggaattacccttaaaatcacccctattaaaactcaatggccatcctttttaaactattttactcc

SEQ ID NO: 309886 - DNA, 439 bp, Homo sapiens
aaatcgagtcgtacgctcacccgacggggtgctttagattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309887 - DNA, 502 bp, Homo sapiens
cccgggtgtccagtccatcctcccttttggacgttggaggggccgcagcgtcatctccgatgcaccctcatcctcagataccgggtagagatctcgccggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309888 - DNA, 681 bp, Homo sapiens
ggcacgaggtgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctggggggactgggggacacagcagcagaggccaagaagctggctgtggtgtctttgctgagggtcacattgagctgcaggttgaatccggggtgcctttaggattcagcaccatggcggaagacatggagacccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 309889 - DNA, 1228 bp, Homo sapiens
ggcacgaggtgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctggggggactgggggacacagcagcagaggccaagaagctggctgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagat

SEQ ID NO: 309890 - DNA, 1297 bp, Homo sapiens
  misc_feature (606)..(606): n is a, c, g, or t
  misc_feature (732)..(732): n is a, c, g, or t
  misc_feature (743)..(743): n is a, c, g, or t
  misc_feature (813)..(813): n is a, c, g, or t
  misc_feature (1272)..(1272): n is a, c, g, or t
ggcacgaggtgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctggggggactgggggacacagcagcagaggccaagaagctggctgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggaggtgacagcggtggtctcattcctggaaaatctcttgtgtttgcaactatggagctgctgatgttcattttagtacggcatatgccacatctcagtaccaaggtgtcagactctccaagtcacatagccactaanactcgactatcagaagaaagtgctcgtttggtggcagccacagttaccatactctctgatttaccatccctttgttcacccgctggatgtatgacaatcctgcccacaattctgttcttaattgcnagaatattganagacacagcaataaagtctgcagataatcaggttcctccaccagtcagtgcagctcttcaagggattaanagtattgtgacactttcaatggccaaaactgaggctggcgttcaaaaacagtggacagctctgattcgtagcacgcttgcttgcatcctggaatattctcaaccagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgangacaaacagagtcagctacttgctc

SEQ ID NO: 309891 - DNA, 2523 bp, Homo sapiens
tcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctatcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgc

SEQ ID NO: 309892 - DNA, 2814 bp, Homo sapiens
tcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctatcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttcataaaagttggtatgtatcattgtggagtaatatgttttgacggagtgatgtgttgcagtacctgaaaatgtttgctactttacgattataggccagcatacaaaattacagaaaagccagaagttaattgatgtcagctgttttccattttgaaggtgtttcttcctgaagaacttaccagcaatcgcctttcctcaaagcgtaacagctgtgccacataaggtgtccacgttgttaattccacatgtttcctataaaattaaagatggtacagtgtgttcacgca

SEQ ID NO: 309893 - DNA, 2491 bp, Homo sapiens
gaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgc

SEQ ID NO: 309894 - DNA, 2248 bp, Homo sapiens
tactttcctgaaaatctcaggccttgggattggaggcaactgagatcatccctagtagttttccgagttccttcaaatcgcaatgagagatttacatctctcattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgc

SEQ ID NO: 309895 - DNA, 1174 bp, Homo sapiens
cgcgtcgcccacgcgtcgcccacgcgtccgtggacgcggtgggcggacgcgtgggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgc

SEQ ID NO: 309896 - DNA, 706 bp, Homo sapiens
aatcttagctgaaatgattacctttaagtcagttggctttaggccttggcgattgctcaatataattttggaattttaggatgcagcatttcaggtaagtgacagtaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgc

SEQ ID NO: 309897 - DNA, 631 bp, Homo sapiens
gtgaaatccagcctgtcatctgtttctgcaaatttttatcagagcacagccacgtccattcatatatgtattgcccgtggctgctttcacgctacaatgggcaagttgagtatttgtgacagagaccctctggcttccaaggtcaaatatgttaactatttggtcctctatagtttgctgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaa

SEQ ID NO: 309898 - DNA, 386 bp, Homo sapiens
cgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattact

SEQ ID NO: 309899 - DNA, 716 bp, Homo sapiens
  misc_feature (1)..(1): n is a, c, g, or t
  misc_feature (49)..(49): n is a, c, g, or t
ngcttcaaaaccgggcggtcgtagcccaagagggaaagaagaagaaagnaaaaagaggaaagaaaacctcaagctaagttctctctctctctcttcgtgcgaaattcggcacgagcatcaacttctcccaagcagagaaacccgaacccaccaaccaggggcaggatagcctgaagaaacatctacacgcagaaatcaaagttattgggtttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309900 - DNA, 1004 bp, Homo sapiens
  misc_feature (892)..(892): n is a, c, g, or t
  misc_feature (939)..(939): n is a, c, g, or t
  misc_feature (973)..(973): n is a, c, g, or t
  misc_feature (996)..(996): n is a, c, g, or t
  misc_feature (1003)..(1003): n is a, c, g, or t
taatcaaagctcaggaggagagctgcattccactgtttcacagatgctgtgagggtgacaaagatgcagggcacccactggaaacacagacggcactctgcgaaagaggaaggggcgccaggagcttggattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctgaantctctcttctggatggctggatttggcacttctggctgggaattctngcctaggctggtggctccacttgctggtgcttgncgggtggggaaacagggcttaantctggant

SEQ ID NO: 309901 - DNA, 1435 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309902 - DNA, 1724 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatca

SEQ ID NO: 309903 - DNA, 1853 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309904 - DNA, 2627 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309905 - DNA, 2209 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309906 - DNA, 1337 bp, Homo sapiens
ccgaagggttctgtgctaggaaccttacacgtgttgtctcacataatccttaaaactcagaaatgattttaaattaaatagcacagagaggaaaactgactggagagggagcctttgcttagattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309907 - DNA, 1030 bp, Homo sapiens
gctcggtacctctagttatgggttggttctatttcatggtttgtaccttggaaggttgtaccaactttacagcaaagacgcgatgtgcctggaacgatttcacagaatctacaatcttagtcgacttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309908 - DNA, 1368 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309909 - DNA, 1429 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggatcattttggcatctgcttccttctctccaaattttacccaagtgacttctacactgttgaactctgcttacccattcataggaccctttttttttatcatctctggctctctatcaatcgccacagagaaaaggttaaccaagcttttggggtttttgagttgagcgagagagaaactgcatctggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309910 - DNA, 2594 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309911 - DNA, 2583 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtataccacggactgctatacagccaaagccagtctggctggaactctctctctgatgctgatttgcactctgctggaattcttgcctagctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309912 - DNA, 1333 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtca

SEQ ID NO: 309913 - DNA, 1751 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtggaactctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309914 - DNA, 1209 bp, Homo sapiens
  misc_feature (1097)..(1097): n is a, c, g, or t
  misc_feature (1144)..(1144): n is a, c, g, or t
  misc_feature (1178)..(1178): n is a, c, g, or t
  misc_feature (1201)..(1201): n is a, c, g, or t
  misc_feature (1208)..(1208): n is a, c, g, or t
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctgaantctctcttctggatggctggatttggcacttctggctgggaattctngcctaggctggtggctccacttgctggtgcttgncgggtggggaaacagggcttaantctggant

SEQ ID NO: 309915 - DNA, 1119 bp, Homo sapiens
  misc_feature (1087)..(1087): n is a, c, g, or t
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggtgcatagcagcctggttggaagcattctgagtgctctgtctgccctggtgggtttcattatcctgtctgtcaaacaggccaccttaaatcctgcctcactgcagtgtataccacggactgctatacagccaaagccagtctggctggaactctctctctgatgctgatttgcactctgctggaattcttgcctagctgtgctnacttgtgtgctgcggtggcaggctctctgctt

SEQ ID NO: 309916 - DNA, 2472 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagtgctctgtctgccctggtgggtttcattatcctgtctgtcaaacaggccaccttaaatcctgcctcactgcagtgtggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309917 - DNA, 2796 bp, Homo sapiens
  misc_feature (1372)..(1372): n is a, c, g, or t
  misc_feature (2178)..(2178): n is a, c, g, or t
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggggtaaatctaattcagaacgtgttggagaggggttgggggaagtgccaagagatgatatatgtcttgggactggacatctgtcgtgagtgtggagaccctaaaattttgctagagggactttagggtagaagccacttggagaaaactgtcccagaacttttccacaagaggttgtcttaaaaatatattttcccttattctgaatatgaggaattgattttctattgttgtctttgtatttttacaatacagtgcttttctatattttcttttacaaaagtaatggtggtaaataatgacatattgtgtgtatgtgtatatattccacaactgcatgcttaataatccaaactgactttttgcaaataatttttccctcactgcaaattagaggaaatatacaactccttttcctcttttctcctaacgtttttgagaatggaaatgatattcaccttttgtttgtctgtttctcctctcacccagaatttattaaagaagctgtattgcatgaagggaggagagaaagaagggatctatcttggattgggagggaaacacagagttttggtttctagaattgcctctgcacttatgtgatctgaggtgaggcactctgtttgactggatttcaggacctggtgggactggtttccttgcctcatgtacaatcacatggntttctatgaggctcatgtgacataaggtctagaaaactttttggtaaatgataatagagctgtgaatctctgaggtggatgtcaggaaggaaaactacctcctaagacagagcttcagttatacatgagaacatgcagtatttggtttctgtccctgtgttagtctgctaagggggatggcctctaaatgatgagaacacatggacacgtagaacagaacaatgcacactgaggcctttcagagggtggagggtgggaggagagagaggatcaggaaaaataactaatggatactaggcttaatacctgggtgatgaaataatctgtacagcaaacccccatgacacaagtttatctatgtaacagacatgcagttgtacccttgaacttaaaataaaagctaaaaataaaagagcttccagagcttcagctatagggttgtgaactgcagtttccgaggaagtgaccaaaggggcaaactccatgtccagtggagtctgggagatgaggggagggccttctgcactgccaatactgcagagaatgtgggggctttcagatgtcccctgttttcagagagatagaaagagagttaactagtcatggacttagaggtcctgagagctgggaaagtaaatctcagcacttgctgtgagctggaagcaagtctcatgagcagaccagggcctgagaggcagaaatgcagaagccttcctgagcacctgccagacacctgagactgtggcttctgtggcagagctgcacaccctccaggatgtcttttcatatttctcactccagagttnccacagggtttgtatcctcattaggatcttgcagaaggcgataatgcattagtgccatgggagcggcaaaaaggccctgtctttacaaatgctggttttcatcctcaatctcactttctcttcccacagactatccagatcttgtgtggcatgatggtattgagcttggggatcattttggcatctgcttccttctctccaaattttacccaagtgacttctacactgttgaactctgcttacccattcataggacccttttttgtgagtagagtttctgaggagggcaggatggggcaaagaggggaggaagatgccaatagcttagacttcccacctgccagcttgctatgtttgatctgccaggagcaaggagtcaacggtgaatcttgttctcctgtcgggtaggatgacaggggttgcttgattttagatcaatttcttatcagactcaaataaacatttcttttgaagatcatcttattcttcacattatcatcttgagctatgatgaagctagtgacttctctccaggtttaggcgaaaaaaaaatccatgaattaggataaagttgggaaggaacattttatacaaaaaaaaaaagagcataaatggaag

SEQ ID NO: 309918 - DNA, 1840 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggggttgatgttggagattatgtgagagaatgtcataccatgcaattgcaccgagactcaatttggaagctctggctacaaaaatctcccaaagccagcaaggaagtgagaaacggcatccagaaaaatgccaattctttttctcatcggtatttagagattattatttggaaccctcagttagactcggaactactaactagatctgtgctgtttaatttaactttctttgaggatggaaatgaaatgtaactttctatgatgatagaaatgaaatgtaactttctatgatgatggaaatgcactacagctgtactgtacaatatggcagtcacatgtggctatcgatgatgtgaaatatagtgcaactgaataaaaatttctcttaattttactttaaatatagatagtctatgtggctattggcaaccatactgagtagcctggcacaagggtagtgctttcaaacttttaggaggaaatatatgggcctgttactccagagaacaatcccacagtgaacatgcaggaagctcaaggatgcaggatgtggtctcggggtgggctcagacttaccagagacatcgaggctttagcgagttctactcttgtcacacattgcaccagccctttttgagattgaagaagagtgccatctcaagacaaatctagcttattctaagaaatatagactctaggcatcaagaatactactggctactaggaggcccaggagtgtacacttcagtcattatgttgggaaattggggtcccagagcatcaactggtgagttcctaaaagaagaagtgcccatgtgggattaagtaacattctactgtatggctgtgaggtgtgccctggagcctacctacctgtaactatagctctcagagtactcttagctcaattctcttttctgtgtgagttggagtacaaaagaagtcacttctgaggtta

SEQ ID NO: 309919 - DNA, 1780 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttaaccaagcttttggggttgatgttggagattatgtgagagaatgtcataccatgcaattgcaccgagactcaatttggaagctctggctacaaaaatctcccaaagccagcaaggaagtgagaaacggcatccagaactcggaactactaactagatctgtgctgtttaatttaactttctttgaggatggaaatgaaatgtaactttctatgatgatagaaatgaaatgtaactttctatgatgatggaaatgcactacagctgtactgtacaatatggcagtcacatgtggctatcgatgatgtgaaatatagtgcaactgaataaaaatttctcttaattttactttaaatatagatagtctatgtggctattggcaaccatactgagtagcctggcacaagggtagtgctttcaaacttttaggaggaaatatatgggcctgttactccagagaacaatcccacagtgaacatgcaggaagctcaaggatgcaggatgtggtctcggggtgggctcagacttaccagagacatcgaggctttagcgagttctactcttgtcacacattgcaccagccctttttgagattgaagaagagtgccatctcaagacaaatctagcttattctaagaaatatagactctaggcatcaagaatactactggctactaggaggcccaggagtgtacacttcagtcattatgttgggaaattggggtcccagagcatcaactggtgagttcctaaaagaagaagtgcccatgtgggattaagtaacattctactgtatggctgtgaggtgtgccctggagcctacctacctgtaactatagctctcagagtactcttagctcaattctcttttctgtgtgagttggagtacaaaagaagtcacttctgaggtta

SEQ ID NO: 309920 - DNA, 2333 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattggggtgcatagcagcctggttggaagcattctgagtgctctgtctgccctggtgggtttcattatcctgtctgtcaaacaggccaccttaaatcctgcctcactgcagtgtggaactctctctctgatgctgatttgcactctgctggaattctgcctagctgtgctcactgctgtgctgcggtggaaacaggcttactctgacttccctggggtgagtgtgctggccggcttcacttaaccttgcctagtgtatcttatccctgcactgtgttgagtatgtcaccaagagtggtagaaggaacaaccagccaatcacgagatacacatgggagggcatttgcattgtgatggaagacagagaagaaaagcagatggcaattgagtagctgataagctgaaaattcactggatatgaaaatagttaatcatgagaaatcaactgattcaatcttcctattttgtcagcgaagggaatgagactctgggaagttaaatgactggcctggcattatgctatgagtttgtgcctttgctgaggacactagaacctggcttgcctcccttataagcagaaacaatttctgccacaaccactagtctctttaatagtattgacttggtaaagggcatttacacacgtaactggatccagtgaatgtcttatgctctgcatttgcccctggtgatcttaaaattcgtttgcctttttaaagctatattaaaaatgtattgttgaatcaaacccctatggacttatggctttatttaactgaattaaaaagccttgatttatccaaaattgtattatagagtgtagaatgaatactagggtgataaattgcaattatttgaagaacctggtgatatgctctacttatcttggattagctaagaattctatgtatacagttggaaaaatggcatatatacatctatcttgaacctgattgaagtctgaagacctaacatattttgtttcttctagagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcaaaaaagatatgtgttcattggggatctcttgatttgcctgacattgacttcagcaaaagcacggggctgtaaattaccatttactagattagccaaatagtctgaatttccagaaaacaaggcagaatgatcattcccagaaacatttcccagaaaatgtttcccagaaaactagacagaatgatcattcaatggatcacagtgaagcaaaggacacaactttttattgtaccccttaattgtcaacaggagttaactgatttgttgtggtgctcagacttttttatacaggtgctagtgttttatcctatgtattttaactcattagtgcataaaggcaagccccatataatgaagtctcagggtatatgaaagtagctggcttcaaaataaaatttttgagtgcatattttgtttt

SEQ ID NO: 309921 - DNA, 2056 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccttttttgtgagtagagtttctgaggagggcaggatggggcaaagaggggaggaagatgccaatagcttagacttcccacctgccagcttgctatgtttgatctgccaggagcaaggagtcaacggtgaatcttgttctcctgtcgggtaggatgacaggggttgcttgattttagatcaatttcttatcagactcaaataaacatttcttttgaagatcatcttattcttcacattatcatcttgagctatgatgaagctagtgacttctctccaggtttaggcgaaaaaaaaatccatgaattaggataaagttgggaaggaacattttatacaaaaaaaaaaagagcataaatggaagacatcacacactcacagagaaaccacactgttatcccccccatgcttgtggggatcatggaggaaggagaacttacacctctgagcattttgaaaatacttttactgcattgactgattcccaggtaaggctgagcagatatctatgcccagtgattgacaggaaattcctctgaaatagctgcaagtctggagtttcttctcataggtaagtttccctttcatagatgttttttccttcaacttcctgcaattcagtagctatttgtttttcttacatttgtgtatttgatgcaccaagaagtccacctttttgtgtatcttgtccatttttcttgtcttattaactaaagttacacttggatttggatttcattggttttccccaaatgacctttttctgttccaagatccatgccaagctactactttacactacattacattttgtcatgatgtctcctcagggtcctctaggctgtctaagattttccttttccttgagaactttgatagttttgggtagcgctggctgagatttttatagaatgttcctaaatttgggtttgtctgatttttttttttgatgtttaaagtatggtgatgaatttttgggtggtgatgatgaggtaaagcaccattttcatcaagtcgtatcaagggtcatgctaccaacataatgtcactgacacaattaaccttgattatgtggttggggtagtattttccagatttctcctctgtaaaattactacttttttttttaaccattgcttttatgtccttccctagagaacatcttacaccaaaactgtctcattttattaaaaaaacaaaaattatttcctggcttttaaggtctttttttgtttagtgg

SEQ ID NO: 309922 - DNA, 2110 bp, Homo sapiens
taatcaaagctcaggaggagagctgcattccactgtttcacagatgctgtgagggtgacaaagatgcagggcacccactggaaacacagacggcactctgcgaaagaggaaggggcgccaggagcttgggtgagcaaggttggaggtgattctgcccctctccccaggctttctgtattagaaaactgaagcttcaagaacagacttgcctaacaacaggaaacttgtatgtctcgaagtggcaattcacacataaggctccatgactcctgaactctcacaaatattagttggctcttttcatggttttactgaccttgctagaagtttacagcaacggaagtgcaggaacatttcacaaatctacaatctgtgagtatcacatcctgtatagctgtaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggacccttttttgtgagtagagtttctgaggagggcaggatggggcaaagaggggaggaagatgccaatagcttagacttcccacctgccagcttgctatgtttgatctgccaggagcaaggagtcaacggtgaatcttgttctcctgtcgggtaggatgacaggggttgcttgattttagatcaatttcttatcagactcaaataaacatttcttttgaagatcatcttattcttcacattatcatcttgagctatgatgaagctagtgacttctctccaggtttaggcgaaaaaaaaatccatgaattaggataaagttgggaaggaacattttatacaaaaaaaaaaagagcataaatggaagacatcacacactcacagagaaaccacactgttatcccccccatgcttgtggggatcatggaggaaggagaacttacacctctgagcattttgaaaatacttttactgcattgactgattcccaggtaaggctgagcagatatctatgcccagtgattgacaggaaattcctctgaaatagctgcaagtctggagtttcaaaaggacttagtagtcctttcctcagagaactgctttctctaagatgggggctttctcataggtaagtttccctttcatagatgttttttccttcaacttcctgcaattcagtagctatttgtttttcttacatttgtgtatttgatgcaccaagaagtccacctttttgtgtatcttgtccatttttcttgtcttattaactaaagttacacttggatttggatttcattggttttccccaaatgacctttttctgttccaagatccatgccaagctactactttacactacattacattttgtcatgatgtctcctcagggtcctctaggctgtctaagattttccttttccttgagaactttgatagttttgggtagcgctggctgagatttttatagaatgttcctaaatttgggtttgtctgatttttttttttgatgtttaaagtatggtgatgaatttttgggtggtgatgatgaggtaaagcaccattttcatcaagtcgtatcaagggtcatgctaccaacataatgtcactgacacaattaaccttgattatgtggttggggtagtattttccagatttctcctctgtaaaattactacttttttttttaaccattgcttttatgtccttccctagagaacatcttacaccaaaactgtctcattttattaaaaaaacaaaaattatttcctggcttttaaggtctttttttgtttagtgg

SEQ ID NO: 309923 - DNA, 2725 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaca

SEQ ID NO: 309924 - DNA, 2725 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaca

SEQ ID NO: 309925 - DNA, 2764 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctacctgggttaggtctacctgggttaggtctaccaggtctacctgggttaggtctacctgg

SEQ ID NO: 309926 - DNA, 1016 bp, Homo sapiens
gcaggtgtttaaggtttaaccttcttcagggacaaattctgactgttggggaacttactctgcaatataaaaatatcttcatgctctggtagggcttggatggttgaactctgtactgccttgtgtgcacttcagccccgaccccctctgattctctgttgaaaagtgtgtcctttctctctgtctgtacatgtttaacatgacgcaataatttgagggcaaacttagtagtgagtgtgtatgatagaatcaagagaattatgggacgcttacttgagaaaatcattaccatgatttggttctaggaaaaaggcattatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaca

SEQ ID NO: 309927 - DNA, 2779 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaca

SEQ ID NO: 309928 - DNA, 2202 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaca

SEQ ID NO: 309929 - DNA, 3089 bp, Homo sapiens
gtttttgctttcatttctcctgctgggagaagtggcggttcatgtgtcattccagtatctcacatactcacacggggcaggggggagggggaaacggggaactatagcaatatttaaagatgctttggaaaccaaccgtgaacacatcaacaccacgacgtctacgattacttgctattggccctcggatacatttaagagaaagagacagtcactcttttttttcttaaatgatatacatataaacagttatttttatcctattataattgtcttttgtctttatctagtactatgtggaaagggtttgcatcatagatttttcccagccttataatataccataagctcctacttccctgcccctccctaatcagtattctttcaagagttctttggtgaagccatctatctgaaactaaaatgaaccaaacccatatttcactggtggttggagaaaaccatggccaaaacgattgtggcaggtctcaatcttgggagtttttaagaaggaatgtgccagaggccgattcccaagaacagagttttcttttgttttgcagaggcattcaatgtgtctagtgcttgctggccacagcagttactaccacagagccttctgggaggggccgttgtgttgaaggaggctcctgcctgagggacagcatcaggcagtgggctctgtagagtgagaaccaggtggaggccttctgtgcccagctcagagttctgcaccacgccaggactgcccaggccaagggctactgacgcaagttccactcattccactctgtggggggcgccttgggcctctcctggaagggctcttggagaaggaattggagttacgtacaagtgacctaaatgggaagcttttctagatgagattggattaaattccatgtgatttctctttccctttaatccaggttgggactcgtttctttctggtggatcacagctgcccagatgttgcaattgatttttatgtttctgtagagaagtatttttctttcatcttcaggattttttttgccaccaaaagaaaacattggaactctgtgtttcctcttgattgtgacttcccagtgttgacagttaagtccttagtgtcgtaggtcccagcccaccaatactatatcaaacactgttatgcacataatgcagcactgtgatctaatttaaataatacttttttattatttatactactatatataatatacatcaacacttttgctatataacctaagtgataaccctcttttagttacctgccaaactctggacttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgtctccccccttctgcccccaccttatttaacatccaaaaattttacttttggcccaaaaatccgcatctttttgcgaatttccccctatagggggctcataaaatttccacgcccgggtttttaaacactattgcttggga

SEQ ID NO: 309930 - DNA, 4521 bp, Homo sapiens
tcctctcccttccccgcgtccctccgcccgccctcggaagaccgagacagcggagaggttgcgggtgagctgcgctgagcccaggagccgaggagtcgggagcgcagcgcagcccgagcccgagcccgagcggccccgcgtcccgagcgcatcggagcggccgagccgcccggcgcagcgcctgtcccgggcagcgcagccccggccgcaggatctcacccaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagcccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaat

SEQ ID NO: 309931 - DNA, 4463 bp, Homo sapiens
tcctctcccttccccgcgtccctccgcccgccctcggaagaccgagacagcggagaggttgcgggtgagctgcgctgagcccaggagccgaggagtcgggagcgcagcgcagcccgagcccgagcccgagcggccccgcgtcccgagcgcatcggagcggccgagccgcccggcgcagcgcctgtcccgggcagcgcagccccggccgcaggatctcacccaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagcccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagacacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaat

SEQ ID NO: 309932 - DNA, 4467 bp, Homo sapiens
tcctctcccttccccgcgtccctccgcccgccctcggaagaccgagacagcggagaggttgcgggtgagctgcgctgagcccaggagccgaggagtcgggagcgcagcgcagcccgagcccgagcccgagcggccccgcgtcccgagcgcatcggagcggccgagccgcccggcgcagcgcctgtcccgggcagcgcagccccggccgcaggatctcacccaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagcccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccaccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaat

SEQ ID NO: 309933 - DNA, 4344 bp, Homo sapiens
tcctctcccttccccgcgtccctccgcccgccctcggaagaccgagacagcggagaggttgcgggtgagctgcgctgagcccaggagccgaggagtcgggagcgcagcgcagcccgagcccgagcccgagcggccccgcgtcccgagcgcatcggagcggccgagccgcccggcgcagcgcctgtcccgggcagcgcagccccggccgcaggatctcacccaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagcccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaat

SEQ ID NO: 309934 - DNA, 4398 bp, Homo sapiens
tcctctcccttccccgcgtccctccgcccgccctcggaagaccgagacagcggagaggttgcgggtgagctgcgctgagcccaggagccgaggagtcgggagcgcagcgcagcccgagcccgagcccgagcggccccgcgtcccgagcgcatcggagcggccgagccgcccggcgcagcgcctgtcccgggcagcgcagccccggccgcaggatctcacccaaggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagcccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccattcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaat

SEQ ID NO: 309935 - DNA, 339 bp, Homo sapiens
ccctccaaccttaccagaaattggcattttcctctaccacctggacatttccttcccaatgcccggactgtcaatgtccacatcctctcgtggtcacaaagccctcagtgcttcatctaatctaccctgaagcctaatcccagccccatcagcctccagagtccatgtggtctgtgaactggatgcagtgggcgccggggacaatgcacctgttctcacctcttttcatcttgcaggggggtatttatgtcttcaaactctttgactactactctgccagtggcatgagcctgctgttcctcgtgttctttgaatgtgtctctatttcctggttttacg

SEQ ID NO: 309936 - DNA, 368 bp, Homo sapiens
ttgaccaaacagcactttctactgattagtataatgggcctcacagtccccagctacctcttgaatcacggtgatgacggtgtcagcacagttctagggcggggatatcatctgtggccatgccctgggcacccctgggtcactccggctcccaccagctctgtgtaactttctcctccctccactgtttgaccaggcgcaacatgcatcagatgacggacgggctggataagccaggtcagatccgctggccactggccatcacgctggccatcgcctggatccttgtgtatttctgtatctggaagggtgttggctggactggaaaggtaagggatatatgtgcacagtggggacaggagggcact

SEQ ID NO: 309937 - DNA, 972 bp, Homo sapiens
ttcttttaactacagtttttgaaaactgtggacctgagatgaaaaagcaaaagccatgacagctgggaaggcactggtccgagaacaccggattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatc

SEQ ID NO: 309938 - DNA, 681 bp, Homo sapiens
acagatagaatactggcagaatggaaatgactggcatgtcagtgatgagtttatagagaagcatttaggattttcctaggtcccgcagtcagtgggtgttcttgctgcaagtgcgtcagtcaaacccaatcaaaagaaatgtcggcttgtttcctagacactagacgagcggcctttctgcagtgtgacctgccttcctcttacaggatactcaccctgccggagtctggtcactgtgggtcagctgagccagtttctgatgctcctgctctcctcctttcaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatc

SEQ ID NO: 309939 - DNA, 1185 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcaaaaaaaaaaaatcgggcatattcggggggaaaaggttgagggcgtgcaatgttcgaccctttgtcaggggaatgggtccatgggggaaagaagtatttttttttttttggaagaaaaaagaggaaggaaaaaaagaaaaagaagaggagagaggaaaagaaggataggaaaaagaagagagaagggaagaaaagat

SEQ ID NO: 309940 - DNA, 279 bp, Homo sapiens
  misc_feature (4)..(4): n is a, c, g, or t
gagnccgagacggcgccagcaggcagaaatgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatc

SEQ ID NO: 309941 - DNA, 2286 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgtttcctgtttagaaagttctgctccttcataaggaccttgaagtactaggaggaaaggtgctttgtgtgtggagttttccatgaagtgcagtcccaactaaaaggctgcgttaaagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309942 - DNA, 2166 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgtttcctgtttagaaagttctgctccttcataaggaccttgaagtactaggaggaaaggtgctttgtgtgtggagttttccatgaagtgcagtcccaactaaaaggctgcgttaaagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggggatttttggagtttcgagccgttcctccctccatctacttcatttcccctcaactagtctggctttcttcaccctattcctatttcttcgctccccg

SEQ ID NO: 309943 - DNA, 2170 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309944 - DNA, 1916 bp, Homo sapiens
  misc_feature (16)..(16): n is a, c, g, or t
  misc_feature (25)..(26): n is a, c, g, or t
aaggcaggtacgagcngggtggtgnnggactgaacaaatattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309945 - DNA, 2020 bp, Homo sapiens
acagttggctcttggtaggtgaggcttccccggacgggttgagtgctcctgcttagaatgtaagctccatgagggaaagtactttgttgctcttcttctcctcagtatcctcagcgttaggacaatgcagtgatattgaatgaattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309946 - DNA, 2013 bp, Homo sapiens
ctgaaagcttttctaactcacttggtggtaagatcggacttgaacaaataatgtaagctccatgagggaaagtactttgttgctcttcttctcctcagtatcctcagcgttaggacaatgcagtgatattgaatgaattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309947 - DNA, 2373 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgtttcctgtttagaaagttctgctccttcataaggaccttgaagtactaggaggaaaggtgctttgtgtgtggagttttccatgaagtgcagtcccaactaaaaggctgcgttaaagaatgtaagctccatgagggaaagtactttgttgctcttcttctcctcagtatcctcagcgttaggacaatgcagtgatattgaatgaattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309948 - DNA, 1385 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtacggtgtcgctattagcgacaccgtacagggaggaatttgaagtagatagaaaccgacctggattactcccgtctgaactcagatcacgtaggacttaaatcgttgaacaaacgaacctttaatagcggctgcccatcgggatgtctgatcaacttcaggtcgtaccctatgt

SEQ ID NO: 309949 - DNA, 1174 bp, Homo sapiens
tgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagcccggagccccgcgcggggcagccccccggggaggagcctcgtgctctgggacgcgtgccgcgcactggcacggctggggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatc

SEQ ID NO: 309950 - DNA, 1600 bp, Homo sapiens
tggcacggtgaagagacatgagaggtgatcttgaagatcacctcatcattatacttcttatgttaccatgaagtctatgtaactaattatgttaaaaaatttgaacaggatcaagcacgtagtatctatatagtaactattgcttctgccattcttcaaggtttactttttaatcagagtattttgtgaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcagggagtaagtacttcaaagacagaagacactggcacacattatggaggagatcctctagagcac

SEQ ID NO: 309951 - DNA, 985 bp, Homo sapiens
  misc_feature (654)..(654): n is a, c, g, or t
  misc_feature (714)..(714): n is a, c, g, or t
  misc_feature (721)..(721): n is a, c, g, or t
  misc_feature (788)..(788): n is a, c, g, or t
ctgaaagcttttctaactcacttggtggtaagatcggacttgaacaaataatgtaagctccatgagggaaagtactttgttgctcttcttctcctcagtatcctcagcgttaggacaatgcagtgatattgaatgaattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaccagcatctcattagttgtgacacgtgacagngcacgacgaggaaccaagccttgatgacgtgggagcgatatgccagcaaaggaagcagangactganaacacggcagcatttgagaactgccacagcttgcatgagcccaatgtgagaactgctatctcgtatnctcttagagaactgagagtggtaacagttttcagaatcggcctccgctggtctttttcaaaattgcaccttagggtttggtttcttacagcgtatggaaaacgggtcgctttacattctatgactgctatagcgtcatactaacttctttgggttgcgcccactgggattgggaatgaagttgagacgtcttattaa

SEQ ID NO: 309952 - DNA, 2136 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309953 - DNA, 1451 bp, Homo sapiens
gagatgtttgaaataactaaaatctaaattaggctgttaaaaaatgtctgtgtaattgtcaatggcattgaacaagaaaaggcagcattttttttctctcagttatttataacctataagaaaaagtagctgtatagcactatgtttttttttaacaatttgattacatgatgaagattttctgctgtcacaatcacagcattacaacagcatgatttaaatactatttgcaaaaccaaaagccaagtagctgcttatattacaaacatttttttggtttccataaccatttagtcaaataaaatattatatggaaattgactatttaaaatctaattgctaggtcatgtagggaacacagaggtgtagaagattgatcctgccctcaaatgtataaaccattaagtagtcaaatggctacagtgaaaaacagtattttatagtaggtatagataattggcacagataagctcagaaaagaatgatcagttcttgctggagtaattctagggaaatggctttcatggagaaaaggaaaagaggaagtgtagtatcagtctatgttgtctattgctaatgtggaatggtgttttctgcttctacgccttactgattccagtttttatatttagaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309954 - DNA, 1530 bp, Homo sapiens
acagcaggagggattgatcgagctcagtcaatcaaggctgattgagggaggttagggcttcagtaggccgtgatcatgctatcacactccatcctgagcaacagtgagaccccgtctcaacaaaaagaaaaagaaaaatgtgttaagccatgagtcttataacacagcattagtgtctaaggagatatgtgttgtgggagtagtagataagattacagtatttaatcttcatttctttatttagatactatggataattgggatgagaaaaagctggaagaagtagtgaacaagaagcacggtgaggcggaaaagaaaaaaccaaaaactcaaatagtatgtccttttcttgaattgagttgctgtgatatttatcattagggagaattatgtggcaaggtatttgctgctattttctattagattattctgtaagttactggaaaatttgatttcatcaagataaggtacacgaagctttatttttggaatttacaagttagattttatagattcttgttcagaaatagctgaacaagaataaaactatgttaccgaagtcctttaaatgccattttctgaggtgaacgttctcaaatatggataaacaaaattacatatccagacaaaaatccctatttttttgcacagagtggaaggaggcctgttaaactaacccacttaataatgtatttagttttaatagggatagatttttaaattttaaggtttaaaatatttctacatatgaattccaaaatgaatttttggtaggtagtggctctaattccaggaaatgtacctttaaaaattggttcttgatgtctcaaactttgcatttatgtctatatttatagtgaagttacagtaaaaagtcttgctgtgctagaataattctaaatactacattcatacacatctgttatgtttgtttttgggggcggatactgtttgttaattttctcttacttgcaaagcttaatacttgaggcttaaatacaattgtatcttctatccatgttgtgaagggtcactctctttgtgttccttttgtaccttgctcctgtatactgcttgtgattcatttttatttcggaaagatcaaaccaaagaaaatcatttattctatttattttatttttgaggcggagttttgctcttgttgcccaagctggagtgcagtggcgcaatcttagctcactgcaacctctgcttcccgggttcaagagattctcctgcgtcagcctcccaagtagctggggttacaggcatgtgccaccacggccagctaattttttgtatttttagtagaagtggaggttcaccatgttagccaggctggtcttgaactcctgacctcagcaggtgatccgcccgcctcggcctcccaaagtgctgggattataggtgtaagccacaacgcctggcctgattttattttttatagctaattgtatattctgattcgggggcgtacatttacaaagggtaactgaaacagaatatacaattagctataaaaaaaaaaaa

SEQ ID NO: 309955 - DNA, 801 bp, Homo sapiens
tataccaccttgctattctttttaaacgaagtttagaaaaaataattttgaaaatagatcttttgtttttgttttttatagagacaaggtctggctttgttgctcaggctggtctcaaactcctaagcccaggtgatcctccacctcgacctcccaaagtgttgggattacaggtgtgagcctccacacctggccagtaattggtcttttgttttcacttggatcagtgataattttggctcattaagataaatgtcaggagtaaaagaaaactgttcttatttgtaacaactttcttttctatatgttgttaaaggttgatgattcagtgagtgtaaatgacatagatttaagcctgtacatcccaagagatgtagatgaaacaggtattactgtagccagtcttgaaagattcagcacatatacttcagataaagatgggtaagtatgctaacttttgcctaattttaagaactaggaagttatctaaagggggttataccaggcttggcaaacttagatgtgtgcaggtaccagattggtaacataaatgtgtggtttgaccataaataaaagcagtaataaatagtgaaaggctgtagacatgagcagctgggtgtatattaaaatcattaatggaaactagaaggagacaaaaatgagtttggagttaaagtcaatgagttcacttcgggacctcatgagtttgagattttttgattatcaaaagtgcactgtctaggatattgtgtagacatgaacaccctacagaacatcagtgttatggggtaagtaaaagaa

SEQ ID NO: 309956 - DNA, 370 bp, Homo sapiens
taagttactggttgtaattggttataggaatagggtgccagtttcattgagactgcaatgataacggtgagaagaaaaatgaatacagtcctctctctcttaatgtttagagggaagacatggtcatgggaagggctttttaggatatggaaaacctaaatgtatctgtagctcagaggaagaggatctggtaaggaggagaagttgatgataaaagattagttatagaagcaatacatgaaagtataaataatgagttaggtatgagaatggagggaaggctgtctagggttgttggtataatttatgtctaattgtgccttgagttaggtacttgaagaaaggggtaaaagtttggcatgcttgctct

SEQ ID NO: 309957 - DNA, 2216 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgagggaagacatggtcatgggaagggctttttaggatatggaaaacctaaatgtatctgtagctcagaggaagaggatctgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309958 - DNA, 2074 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309959 - DNA, 2205 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaacacaccagcccacaccacaaaaccaatgggggccgccagggcccaaaaagtttcaacccacgggggc

SEQ ID NO: 309960 - DNA, 2652 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaaaaaaaatgaaaaaaaaaattaaaataatgaaaagtgagactgaatgataaaggagtctctatatctctttatgtaaacattgcggtataaagtctcattccacatatgttacatgacaaacattctccataacactgttccatgcaccacttcataaccttaagctttaatatcgacgactgtgacagtacgaagtgcacataacgttacaatcttggatgccagatcaatcctcccaagacgacgcgtccacctggagttaatcggacgtccaccttagactgctaaacgttttaccggtttgtcggtaatcggggtcattgttcttatcatctaccttcacctttgcgaagattataacacaatagagtataaaagcacataatacgtctcgaaaatatttaaccccctatttactcgattctacaatcacgcaccccctccctccccacacgctctcaccctcacatccctatcctctaaacgtttgatctatctcttgcatagtaataca

SEQ ID NO: 309961 - DNA, 2309 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaaaaaaaaaaatttgtggggctgggctgaaaaatttctaaacatttttggggggggccgtggtatggaaatgggcaacgggtcaaggaaacgggccagcatgggggtttttcacaaaaaaaaggcgggggacaggggttgacaaccaggggttggggtgggtcacaagggccgg

SEQ ID NO: 309962 - DNA, 2380 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaagaaaaaaaaaaaacaaaaaagacacaaaaaaaaattgttgtgggcgggcctgggccctgaaaaagttttttgagcccttccgttggcggcgcggcccgatgggtagtgtgaacctgggccataggcgtgttccaagaaacaccccggccaagactatgggcgtggtcctccccaaaaaaacccggggacacgcggtttggacaaccgaggggccgggcctccggccatcacgggcaaggcgcga

SEQ ID NO: 309963 - DNA, 2204 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309964 - DNA, 1868 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309965 - DNA, 2100 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaataaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309966 - DNA, 3580 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtatgtccttttcttgaattgagttgctgtgatatttatcattagggagaattatgtggcaaggtatttgctgctattttctattagattattctgtaagttactggaaaatttgatttcatcaagataaggtacacgaagctttatttttggaatttacaagttagattttatagattcttgttcagaaatagctgaacaagaataaaactatgttaccgaagtcctttaaatgccattttctgaggtgaacgttctcaaatatggataaacaaaattacatatccagacaaaaatccctatttttttgcacagagtggaaggaggcctgttaaactaacccacttaataatgtatttagttttaatagggatagatttttaaattttaaggtttaaaatatttctacatatgaattccaaaatgaatttttggtaggtagtggctctaattccaggaaatgtacctttaaaaattggttcttgatgtctcaaactttgcatttatgtctatatttatagtgaagttacagtaaaaagtcttgctgtgctagaataattctaaatactacattcatacacatctgttatgtttgtttttgggggcggatactgtttgttaattttctcttacttgcaaagcttaatacttgaggcttaaatacaattgtatcttctatccatgttgtgaagggtcactctctttgtgttccttttgtaccttgctcctgtatactgcttgtgattcatttttatttcggaaagatcaaaccaaagaaaatcatttattctatttattttatttttgaggcggagttttgctcttgttgcccaagctggagtgcagtggcgcaatcttagctcactgcaacctctgcttcccgggttcaagagattctcctgcgtcagcctcccaagtagctggggttacaggcatgtgccaccacggccagctaattttttgtatttttagtagaagtggaggttcaccatgttagccaggctggtcttgaactcctgacctcagcaggtgatccgcccgcctcggcctcccaaagtgctgggattataggtgtaagccacaacgcctggcctgattttattttttatagctaattgtatattctgattcgggggcgtacatttacaaagggtaactgaaacaagtaagtcattttcgtatgatttagaatttagaacaaatgaaaactgtatagattcccctttaagggaatttgccattgttctacatattttaagataaacttctgttgcatttctgcacagaatagaggctagacagagcacccttatgtgcagaaatgaatagaatgtacttgtgtaatataacgtacttgtgtgtatacttgttccatatactcaggcatttaccttggaaatggcctacactgagccaccgcttgtgaataatattgtctctataggtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309967 - DNA, 1521 bp, Homo sapiens
  misc_feature (1459)..(1459): n is a, c, g, or t
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaattttctggggggattgggngataaaaattaatcttgtttaaatgaccaattgtgaaaatattcgagtgaggatatttccaa

SEQ ID NO: 309968 - DNA, 1642 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaatcaacaggatgtttatttcctatgctgattctggaggagttaacctcctgcaaaaaaggcatcttgtccctacatcttctcttctgactttggctacatctcataaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309969 - DNA, 1678 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgggtaagtatgctaacttttgcctaattttaagaactaggaagttatctaaagggggttataccaggcttggcaaacttagatgtgtgcaggtaccagattggtaacataaatgtgtggtttgaccataaataaaagcagtaataaatagtgaaaggctgtagacatgagcagctgggtgtatattaaaatcattaatggaaactagaaggagacaaaaatgagtttggagttaaagtcaatgagttcacttcgggacctcatgagtttgagattttttgattatcaaaagtgcactgtctaggatattgtgtagacatgaacaccctacagaacatcagtgttatggggtaagtaaaagaa

SEQ ID NO: 309970 - DNA, 1444 bp, Homo sapiens
accttatgaggatcccgtgattgagataagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309971 - DNA, 3155 bp, Homo sapiens
acagcaggagggattgatcgagctcagtcaatcaaggctgattgagggaggttagggcttcagtaggccgtgatcatgctatcacactccatcctgagcaacagtgagaccccgtctcaacaaaaagaaaaagaaaaatgtgttaagccatgagtcttataacacagcattagtgtctaaggagatatgtgttgtgggagtagtagataagattacagtatttaatcttcatttctttatttagatactatggataattgggatgagaaaaagctggaagaagtagtgaacaagaagcacggtgaggcggaaaagaaaaaaccaaaaactcaaatagtatgtccttttcttgaattgagttgctgtgatatttatcattagggagaattatgtggcaaggtatttgctgctattttctattagattattctgtaagttactggaaaatttgatttcatcaagataaggtacacgaagctttatttttggaatttacaagttagattttatagattcttgttcagaaatagctgaacaagaataaaactatgttaccgaagtcctttaaatgccattttctgaggtgaacgttctcaaatatggataaacaaaattacatatccagacaaaaatccctatttttttgcacagagtggaaggaggcctgttaaactaacccacttaataatgtatttagttttaatagggatagatttttaaattttaaggtttaaaatatttctacatatgaattccaaaatgaatttttggtaggtagtggctctaattccaggaaatgtacctttaaaaattggttcttgatgtctcaaactttgcatttatgtctatatttatagtgaagttacagtaaaaagtcttgctgtgctagaataattctaaatactacattcatacacatctgttatgtttgtttttgggggcggatactgtttgttaattttctcttacttgcaaagcttaatacttgaggcttaaatacaattgtatcttctatccatgttgtgaagggtcactctctttgtgttccttttgtaccttgctcctgtatactgcttgtgattcatttttatttcggaaagatcaaaccaaagaaaatcatttattctatttattttatttttgaggcggagttttgctcttgttgcccaagctggagtgcagtggcgcaatcttagctcactgcaacctctgcttcccgggttcaagagattctcctgcgtcagcctcccaagtagctggggttacaggcatgtgccaccacggccagctaattttttgtatttttagtagaagtggaggttcaccatgttagccaggctggtcttgaactcctgacctcagcaggtgatccgcccgcctcggcctcccaaagtgctgggattataggtgtaagccacaacgcctggcctgattttattttttatagctaattgtatattctgattcgggggcgtacatttacaaagggtaactgaaacaagtaagtcattttcgtatgatttagaatttagaacaaatgaaaactgtatagattcccctttaagggaatttgccattgttctacatattttaagataaacttctgttgcatttctgcacagaatagaggctagacagagcacccttatgtgcagaaatgaatagaatgtacttgtgtaatataacgtacttgtgtgtatacttgttccatatactcaggcatttaccttggaaatggcctacactgagccaccgcttgtgaataatattgtctctataggtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309972 - DNA, 1379 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggtaagaggaagctttgtgcctcatctccttatgttaattgaaagaaacaataataccacaacatggttaagagccaccaacatcagagccacagtgcctgggttcaaatccttactccaaccatgggttaatctaggcctccaccctcatctaatatggacataatgattatctctacatcatagt

SEQ ID NO: 309973 - DNA, 1379 bp, Homo sapiens
  misc_feature (1364)..(1364): n is a, c, g, or t
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatggtgaaacaaatagtgagctctgaggaggctgaaatgtgaagagtgacttgagagacacagaggaggcgaatgagcatgatctgtctgtgatgaatcttcactgaagatngtgactaagagtatc

SEQ ID NO: 309974 - DNA, 2346 bp, Homo sapiens
ccttttatgaaaggaaaaaaaaaatattgtgatctattcccaaagttgccctactttaattattcttgtatgtgtaaaatgttaacctagccataaacattagccaatcatgacattaattttaggattgtgaaacagtcttttaagtactagctaatggcttatcaaattatttctgtaagattgagttactaaaaatgcttagttctcagattggttgaatttttatagttttagatttttcgccctgatatcttttttcactagtatattagttattagcatatgtacggaagaagacaacactctagtttttaaattatatgttttatcagctctggactcaaaacactcactctgcttatagaagggaatgagtctgaagaggatattcagctacttgtctttggctccgtacaaaacacagttttattctatgaaaattttgagattattagaaacattagatttagggttgcatattaaaaactatatccattttgccttattatttagtgtctcactcaggatataacacactataatagaaaatgtagacttcagaatcaggtatatttgagatggtttgtatactggttctgacacttgttagctattcatctttggtaaattccccattaccctttgttcacctatttgtggggatcagtgcatagtgtgtgtaaagcatttaatacctggcaagtgttcagcaaattttttgttctatatatttattatttgattattggccctgaggagtaggtgtttgtttgtttgtttgtttgtttagttttatttctcatcttctcaggaacacaaatgaaacttggatattgttatggtgctttttataatatatttattattttcagcaattgattcatgttaaaacaatttcttatgacaagttactcatcttcaatggtgagaagaaatctagctcagaataatatatttttagtgtttgtatctctggatactcattttgctcattgccacgtaaagtaaaaaaatacataaattagcttattccaatgtaatatcttcaggatagtcatgggcaaggaattaatcacattaagagataactgcaactaagcactatttgaggtgacttctgtggaaaaaaaattaattctttaccattgcagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaa

SEQ ID NO: 309975 - DNA, 970 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagaggtaactggtatccttttcctaccata

SEQ ID NO: 309976 - DNA, 976 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagattatcgaagacaaaactttcggtttgaagaataagaaaggagcaaagcaacagaacggtaatatctatgctgctg

SEQ ID NO: 309977 - DNA, 354 bp, Homo sapiens
cactctctgccacctttcatagtcagaataaaagaaacaaaagtagacataaatgctacaaaaagaactttaaagaaatgtcttgctaatcacccataagtgccgttttcctctcacatcagtgaatggaaaataagttaaccaaaattcatcatatttcaggtagaatctatactttacagcctggcagattataatacaaataccatatgccatttgacataggtgcagatcccaagtctgtagtatgtgcattcttcaagcaaggacagtgtactaaaggagataagtgtaagttctcccatgacttgactctggagagaaaatgtgaaaagcgaagtgtttacattgatg

SEQ ID NO: 309978 - DNA, 368 bp, Homo sapiens
cgtatgatttagaatttagaacaaatgaaaactgtatagattcccctttaagggaatttgccattgttctacatattttaagataaacttctgttgcatttctgcacagaatagaggctagacagagcacccttatgtgcagaaatgaatagaatgtacttgtgtaatataacgtacttgtgtgtatacttgttccatatactcaggcatttaccttggaaatggcctacactgagccaccgcttgtgaataatattgtctctataggtgtgcaagcatttcctggaagctattgaaaacaacaagtatggctggttttgggtatgccctggagggggtgatatttgcatgtatcgtcatgcacttcc

SEQ ID NO: 309979 - DNA, 807 bp, Homo sapiens
cgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaaatatgggcctttttttaagtttttctatgaaaaatttaacatttctagcttgagaatt

SEQ ID NO: 309980 - DNA, 4198 bp, Homo sapiens
cgcgcgcacacagccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacaggggacaccatcgccctgaacatcatcaagggcaatgaggagggctactttggcacgcgcaggctcaatgcctacacgggtgtggtctacctgcagcgggccgtgctggagccccgggactttgccctggatgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309981 - DNA, 4339 bp, Homo sapiens
cgcgcgcacacagccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagaccaagacgagtgcctgatgggtgctcacgattgtagccggcgacagttctgtgtgaacaccctgggatccttctactgtgtcaaccacacagtgctctgtgccgatggctatatcctcaatgcgcacaggaagtgcgtggacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacaggggacaccatcgccctgaacatcatcaagggcaatgaggagggctactttggcacgcgcaggctcaatgcctacacgggtgtggtctacctgcagcgggccgtgctggagccccgggactttgccctggatgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309982 - DNA, 1953 bp, Homo sapiens
ggggactctgcagcctctgatggcctcgctctccctgcagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacaggggacaccatcgccctgaacatcatcaagggcaatgaggagggctactttggcacgcgcaggctcaatgcctacacgggtgtggtctacctgcagcgggccgtgctggagccccgggactttgccctggatgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309983 - DNA, 1614 bp, Homo sapiens
ggtgatctagagatccctgggcagtactggatgtgcggcagtacggatgtgcgggccagtacggatgtgcgggccagtacggatgtgctgggcagtacggatgtgcgggccagtacggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacaggggacaccatcgccctgaacatcatcaagggcaatgaggagggctactttggcacgcgcaggctcaatgcctacacgggtgtggtctacctgcagcgggccgtgctggagccccgggactttgccctggatgtggagatgaagctctggaggcagggctccgtcaccaccttcctggccaagatgcacatcttcttcaccacctttgccctgtgaggtgccagcacgggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309984 - DNA, 4049 bp, Homo sapiens
cgcgcgcacacagccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgaagtgcgagcgcaccacgtgccatgacttcctggagtgccagaactcgccagcgcgcatcacgcactaccagctcaacttccagacgggcctcctggtgcctgcgcatatcttccgcattggccccgcgccagccttcacaggggacaccatcgccctgaacatcatcaagggcaatgaggagggctactttggcacgcgcaggctcaatgcctacacggggccacctgcgggtgtggcgcagcccagggctcacactgcgtgggagggactgggtcactattgtggtttttactataactttgtaaattaacttaattttgctgacttgactcctgtggcttctggacccctcctctgccccgcaggaggaagttccacggcaggtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309985 - DNA, 3663 bp, Homo sapiens
cgcgcgcacacagccaggggccgcccgggctctcgacgcgccgacggccgggcggacggacggacggacgccgagcgcagtgccccgcgggtcttacaggagaggggaccgtcctgggctggcctggaccatggtgctgctctgggagcctgcaggagcctggcttgctctgggcctggccctggccctgggccccagcgtggccgcagctgcccctcggcaggactgcacgggcgtggagtgcccgccgctggagaactgcattgaggaggcgctggagccgggtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgccctgacgccggtggagagctcatctgctaccagctccccggttgccacgggaacttctcagatgccgaggagggtgaccccgagcgacactacgaagacccctacagctatgaccaggaggtggccgaggtggaagcagcaacagccctggggggtgaggtccaggcgggtgcagtccaggcaggcgcagggggccccccagctgctctgggaggtgggagtcagccactgtccaccatccaggcacccccctggccagctgtcctccccaggcccacagcggctgctgccctgggtcccccagccccagtgcaggccaaagctaggagagtgaccgaggacagtgaggaggaagaagaggaggaggaggagagagaggaaatggctgtcactgagcagctggcagcaggtggccacagggggctggatgggctgcccactacagccccagctggacccagtcttcctatccaggaggagagggcagaagctggggcaagggcagaagctggggcaaggcctgaagagaacctcatcctggatgcccaagccacgtcccgcagcactgggccggagggcgtgacgcatgcaccgagcctgggcaaggctgctctcgtcccaactcaggccgtgcctggctctcccagggacccagtcaagcccagcccccacaacatcctgtccacatcactgcctgatgcagcctggatcccacccacccgagaagtgcccaggaagccgcaagttctgccccattcccacgtggaggaggacacagaccccaactctgtccattctatccccagaagtagccctgaaggctccaccaaggacctgatcgagacttgctgcgcagccggacagcagtgggccattgacaatgacgagtgcctggagatccctgagagtggcactgaggacaacgtctgcaggacagcccagaggcactgctgtgtctcctacttgcaggagaagagctgcatggccggcgtcctgggagccaaggagggtgagacctgtggggctgaggacaacgacagctgcggcatctccctgtacaagcaatgctgtgactgctgtggcctgggcctccgcgtgcgggccgagggccagtcgtgtgagtccaatcctaacctgggctatccctgcaatcatgtcatgctctcctgctgtgagggtgaagagcctctcatagtacctgaggttcgccgacctccagagcccgcagctgcaccacggagagtttcagaggcagagatggcgggccgagaggccctgtcactgggcacagaggccgagctgccgaacagcctgccgggcgatgaccaggatgagtgccttctcctcccgggagagctgtgccagcacctttgcatcaatactgtgggttcttaccactgtgcctgctttcctggcttctcactgcaggacgatggccgcacttgccgcccagagggtcaccctccacagccggaagccccacaggagcctgcactgaagtcagaattttcccaggtggcctctaacaccatcccgctgccactgccgcagcccaatacctgcaaagacaatggaccctgcaagcaggtgtgcagcactgttgggggctcagccatatgctcctgttttcccggctatgccatcatggcggatggcgtgtcctgtgaagacatcaacgagtgtgtgacggacctgcacacgtgcagccggggcgagcactgtgtgaacacactgggctccttccactgctacaaggcactcacctgtgagccaggctatgccctcaaggatggcgagtgcgaagacgtggatgagtgtgcgatgggcacgcacacctgccagccgggcttcttgtgccagaacaccaagggctccttctactgccaggccaggcagcgctgcatggatggcttcctgcaggatcctgaaggcaactgtgtggacatcaacgagtgcacgtcactgtccgagccatgtcggccaggcttcagctgcatcaacacggtgggctcctacacatgccagaggaacccgctgatctgcgcgcgcggctaccacgccagcgatgatgggaccaagtgtgtggacgtgaatgagtgtgagacaggtgtgcaccgctgcggtgagggccaagtgtgccacaacctccctggctcctaccgctgtgactgcaaagccggctttcagcgggatgcctttggccggggctgcatcgacgtgaatgagtgctgggcctcgccaggccgcctgtgccagcacacgtgtgagaacacactcggctcctaccgctgttcctgcgcctccgggttcctgctagcagcggacggcaagcgctgtgaagacgtgaatgagtgtgaggcccagcgctgcagccaggagtgtgccaacatctatggctcctaccagtgctactgccgccagggctaccagctggctgaggatgggcacacctgcacagacatcgacgagtgtgctcaaggcgccggcatcctctgcaccttccgctgtctcaacgtgccagggagctaccagtgtgcatgccctgagcagggctacaccatgacggccaacgggaggtcctgcaaggacgtggatgagtgtgcactgggtacccacaactgttccgaggctgagacctgccacaacatccagggtagcttccgctgcctgcgcttcgagtgtcctcccaactatgtccaagtctccaaaacgtggtgcgttcccacgcaggcaccaagtggaagcttgcacggtgggccacggccgtggcgggtgccctgtgggtgaggctgggtgatgacctgaggaccagagacacgcgaccatgttggggctcttggactcctctggatgacccgtccccaaagttgacattccatttcatgttccactgtgattaattcttttcttttttaaaaaatcattttaaagttttttgtttaattataaagtagtacatgtacattatataaaaaaaagttcaactagtatgaaagggttataaagtaacagaggaaaacgcctcttggtccctttaaaaaaaaaaa

SEQ ID NO: 309986 - DNA, 3435 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309987 - DNA, 3711 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaaaaaaaaacaaaagaaaaatttttgggcgagctgggccctggaaaaatttttttgagacctttggtttggggggggggggcccaagtagtgtacggcgaacacgtggtcacaagcggtgtcccaaaggaaaacccgtggcaatgcacaaggggcggggatccccccgcattaaaaaacgcccggggcacaccgacggtttgggacacatccgagagggagctcagaaggcacaaggggacactaacaacagagctcacaagaaggtcgatataagta

SEQ ID NO: 309988 - DNA, 2694 bp, Homo sapiens
  misc_feature (663)..(663): n is a, c, g, or t
  misc_feature (942)..(942): n is a, c, g, or t
  misc_feature (1129)..(1129): n is a, c, g, or t
tagctttggtaaatagacatatctgctacaaaagatggatggatgtttcatataccttctcttcttcacattttaaaatattttgttttctttttttgttaaaatttagttccagcgtgcagcaccatgagaatacaatagaatggtagagtgactgacttaagctaataataacattctaagattaattgaaacataaatgacccccagaacaaatatctgagtgacaaaaattctggtctttaaaaatgttatctatagttagataaagtttggggcagtggaggctatcttaaaattaatcatccaatgaatatcagcaatggatttacagttttccctctgactttctaggttgtcctggaaaagacctagtgtttctgtagatctgggctcctaaaactctctccgaaaaataataaactagaagggtgctagatatatgttcagtgatgattagaatctttaacattaaacaattattgtttaaaagcaataaatctggctatattctgtccatggctcatatgtatttaaaaagaatggaaagaattttgagagtaaattttttgaatgttattttccttttaaattggaaacttatattggatcatccttaagacatggatggaaaccactggaagaggaaatctatacccaatncctttgagaaattgttaagctacattattggttctctaagaaatagcagtttatagatgacattttagaaaagcaagctcctatcttaccagaggcttacacaggggtgactctgcaaatacatgtaaacaaagtggaattggtgtgagtttgttttaattccaacagctgatgatgctaagtagaaacctagtgaaacaacccttaataaataaaaagcaatagtttgttcccccagtttaattcagtaaatattaagtattaataacatgtgatggnaatagtatctgaaattctcagcctgtggtctggccttgctcttagaggaagaagatgcctctcttccaagttctgattatggtttatgtgacctttggttaataggttaggaggtcagatttgccagaaaaccagtggcaccgtggttgttccaggaggatattttgtcatgttcattaaaagtccnacaagaaaggtgacacatgcttatcccaactttacagtaagtcaagcaaaggaagttctcatgagaaagttggattaaacaaacagcagcaactacaatcatataaggtttagtggatttttactcctttccgctgcaaaggagtgcaaaagaggaatgtctctaacactaggtaattatgctttttatgttttttctcttgtgtggcactctgcctgattttattacaacaaaacatttatgtttctgtattatgtgtgtgtgtatatgtattttatatatatgcattttccgtcccaccctgccaagtcatgatttcttatgcactgaacgtaggggcattagagtagaaggttgcctcaggttagttttgtgtggggttgaatgccttttatttctgacttcatttctatctgccaatggatcaatgcattttactctatattatcaaaatacaatatagtgtaagaagtggatcctggctaggtgcagtggctcatgcctgtaatcctagcactttgggaggctgaggcaggaggattccttgagcccaggagtctgagaccagcctgggcaacatagggagactctgtctctgcaaaaaaaaatttaaaaattagccaggtgtcatgagacacacctgtagtcccagctactgagaggctgaggtggaagaattgcttgaacccaggagtttgaagctgcagtgagctgtgatcacaccactacactccagcctggacaacagaataagaccctgtctcaaaaaaaaaaaaaaaaagtggatactattgtcaaggagcttataatacaatttagtatgggctttaaaaaagatatctaataacaaaaagatgacagtgtaagacagtgaaaaagaggggccagttgcttatatctgataacatgatcttacaaactctctccatttaaaccccaatatgtctgcatttctccagccctcgtttcccagaggctcactttgctcatggaggcctttgttgccaccagctccatcctactttatatttcctcatagcagcacgtgccctgtgctagatttgcttttggtctgtgctcactggaatgtgagctgcatgaaaaccttttgtgcgctgctgaagctctagtgcttgcaaatgtcgggtacatagtagccacttagtaagtattaagtggattgaggaccatgatcattcattgacagtttattaggtttgccttcagctctcagtcccgtgggggtacatggacacataaataggtcatccaagtttagtgagaattggtgggaaggcaagaaatggaaataaggaaggatgggcacttggtcaatatttacatagactttacccaaatattgggctttttgtaaacatagaatctgttgcttcttaaagcctaagcccgttggaaattggggtaatgtgagcaatttctttctttccatcaaagaggtggtatggcatgcaagaaaaagcaagattcaaaactttaatagcatttgtcttgatgtcttgctttagaggactctaagacaattaaaaaatacaataagagtaaga

SEQ ID NO: 309989 - DNA, 743 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggtgagtgtcgttgaccgaaagcatatggtggaaacccaggtggggctttggagacaagcaactctacacgagttctggaggaatgtggctctgctgtgaaccatagctttgtaaaaagatcctttgactcatatttggtggacgttaaggaagaaaggaaattcagggtgtgggaaaaggggtttgcacacaggcacggatggagtagattgggcagtttggattgccttgtgtaaaaaagaaacaaaacaaacaaaccaaccaaccca

SEQ ID NO: 309990 - DNA, 3165 bp, Homo sapiens
ctgcctttgtcctggtgagcacatctgatatggcagaggaaactgaggatgcctggccgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309991 - DNA, 3570 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggtaagtcaagcaaaggaagttctcatgagaaagttggattaaacaaacagcagcaactacaatcatataaggtttagtggatttttactcctttccgctgcaaaggagtgcaaaagaggaatgtctctaacactagggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309992 - DNA, 3207 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcaacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309993 - DNA, 4194 bp, Homo sapiens
  misc_feature (663)..(663): n is a, c, g, or t
  misc_feature (942)..(942): n is a, c, g, or t
  misc_feature (1129)..(1129): n is a, c, g, or t
tagctttggtaaatagacatatctgctacaaaagatggatggatgtttcatataccttctcttcttcacattttaaaatattttgttttctttttttgttaaaatttagttccagcgtgcagcaccatgagaatacaatagaatggtagagtgactgacttaagctaataataacattctaagattaattgaaacataaatgacccccagaacaaatatctgagtgacaaaaattctggtctttaaaaatgttatctatagttagataaagtttggggcagtggaggctatcttaaaattaatcatccaatgaatatcagcaatggatttacagttttccctctgactttctaggttgtcctggaaaagacctagtgtttctgtagatctgggctcctaaaactctctccgaaaaataataaactagaagggtgctagatatatgttcagtgatgattagaatctttaacattaaacaattattgtttaaaagcaataaatctggctatattctgtccatggctcatatgtatttaaaaagaatggaaagaattttgagagtaaattttttgaatgttattttccttttaaattggaaacttatattggatcatccttaagacatggatggaaaccactggaagaggaaatctatacccaatncctttgagaaattgttaagctacattattggttctctaagaaatagcagtttatagatgacattttagaaaagcaagctcctatcttaccagaggcttacacaggggtgactctgcaaatacatgtaaacaaagtggaattggtgtgagtttgttttaattccaacagctgatgatgctaagtagaaacctagtgaaacaacccttaataaataaaaagcaatagtttgttcccccagtttaattcagtaaatattaagtattaataacatgtgatggnaatagtatctgaaattctcagcctgtggtctggccttgctcttagaggaagaagatgcctctcttccaagttctgattatggtttatgtgacctttggttaataggttaggaggtcagatttgccagaaaaccagtggcaccgtggttgttccaggaggatattttgtcatgttcattaaaagtccnacaagaaaggtgacacatgcttatcccaactttacagtaagtcaagcaaaggaagttctcatgagaaagttggattaaacaaacagcagcaactacaatcatataaggtttagtggatttttactcctttccgctgcaaaggagtgcaaaagaggaatgtctctaacactagggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309994 - DNA, 3535 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaatttttcctgaattctgttccccaattatttaacaaggcttttgttacagaacatctgttttgggtaacttgtttttctctataaagggctacagtgtcat

SEQ ID NO: 309995 - DNA, 2800 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309996 - DNA, 3279 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatgtacggatacgcgggatcctcgggtc

SEQ ID NO: 309997 - DNA, 3378 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309998 - DNA, 1108 bp, Homo sapiens
tgctccatcagcattactgttaacttccaggttcctgcaaataatgcgtgttaccactctctccttaactttttgactctgtcgagagagggctcatgtttccttcaggtctctcctctaggtcaggagcatatctagggacatctgtgcttcactcagtctagaaaacctgcttgtcatagccaagccactgctgtgagctcctggcctccagtttagaaggaaacctgctgtccaaactaagatgcgccagtcttcgtcccatcagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaa

SEQ ID NO: 309999 - DNA, 2950 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacaatatgttgccccatctgataataaaaatacaaaggtgctctttaagctaaaccataaaccttattagagaattctagttaagaggtc

SEQ ID NO: 310000 - DNA, 2964 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgtagctgttgtaactggagctgttgtaactggagctgttgtaactggagctgttgtaactggagctgttgtaactggagctgttgtaactggagctgttgtaactggagctgttgtagctgaagctgttgtaactgcagctgttataaccagc

SEQ ID NO: 310001 - DNA, 2451 bp, Homo sapiens
  misc_feature (2401)..(2401): n is a, c, g, or t
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaataataacaaaaaaaaccttcgggtgggggccccgttccccatttgccctattgngaaggcgctttccaattcacttcccggcctgttacaacgttttgactggg

SEQ ID NO: 310002 - DNA, 1492 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaaggtaaactgaacacaatgatctctccttttgttctcatgttcagaccttaaatgttggtgaagatcaaaactattttgaatttgtatcaggttttattaccagtgggggccagatgaggttaaatatatcgctttggtagacgaggcaagagcaggcttttgaggatctagggaaaaactccgggttgaatctggtggggttagaatgggtcccctagccctcttccttgatgtgagcagtagttatagaggttcaattttacttgagagatagctgggcaaagctaagtcataggactggg

SEQ ID NO: 310003 - DNA, 1151 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcgtaagttctcaatgagattcttgatggcagaaaattgaatatctggtagtggtaaaggatgaaaatgctttgaagctattttttttttttggccagtgtgaccttttaatattgatttctgtgtctactgtaatatcccctatagtttgttttgttgttgttttgcccacaacaggcactcattaagtattgtttgaatttaaattttgtcctattggtttctaatggcatttctaagagtttactatagaattcagttgtttgttttcagctttttagtgacctatactttgtttgtgctatttaataaatgttatccatatctaaattagt

SEQ ID NO: 310004 - DNA, 987 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttgggtaagtgagaatgcatagtcttacaacacagttgcgcaattttttatttcctttcgttctagccagttgtattaagccaacttccagttttgtcaagcagttaaagaaataaatcatccaagtacacatgctttaatgaaaacgttatttacatcgaagatctttccccatgagccactgtgcctggccatctctatattatcatacacagtggtttcgctgccctaagaatcctctttgctctgtctgctcatctccccatccctgctaacccctggcaaccactgatctttctcccatccccagttgtgcttagttggaattatacagtatgtatccttttcagactggtttctttgagttagtaatatacatttaaatttcctccatgtctttccatggcttgataactcacttatttttagtaccgaataatattcaaaaa

SEQ ID NO: 310005 - DNA, 774 bp, Homo sapiens
cgcggggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttgggtaagtgagaatgcatagtcttacaacacagttgcgcaattttttatttcctttcgttctagccagttgtattaagccaacttccagttttgtcaagcagttaaagaaataaatcatccaagtacacatgctttaatgaaaacgttatttacatcgaagatctttccccatgagtgttagttaatgcaacttaattatcagatcatcgtagtttatgtagatagacaactat

SEQ ID NO: 310006 - DNA, 428 bp, Homo sapiens
cttttctttcctgtgagaatataaactctgtgaagacagggaagaatgttacttttcttctttatagtgttaagaattgttgagaataatgactagcttataataggcatttaagatatatttgttgaaaaaaatgaatgtagagtcactgctgtattcattttaaaaagctattagactgatttatgcaattccaaggggattatcattgttgaggcaaatttagtgggacttgacccaaacaacaaatatttttccaacaaaatgtctttcttacaaatgtacttttagaaaaccacattttaggaatctatactcttggtttacagctttgtattgtgtaaatgggcagtctctctttgatgggtttgcacacttacctgcctctttcacctgcctctctagatatgaatgccacaatacgaagg

SEQ ID NO: 310007 - DNA, 383 bp, Homo sapiens
ggtttaccagaaaaccccagctctagctgtgaaagctggtcttaaagaagaggaaactgaattgaaacagctgaatttacacaaaggtaaactgaacacaatgatctctccttttgttctcatgttcagaccttaaatgttggtgaagatcaaaactattttgaatttgtatcaggttttattaccagtgggggccagatgaggttaaatatatcgctttggtagacgaggcaagagcaggcttttgaggatctagggaaaaactccgggttgaatctggtggggttagaatgggtcccctagccctcttccttgatgtgagcagtagttatagaggttcaattttacttgagagatagctgggcaaagctaagtcataggac

SEQ ID NO: 310008 - DNA, 1056 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctgcggcgtggactccgtcagtggcccaccaagaaggaggaggaatatggaatccaagggggccagttcctgccgtctgctcttaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatattttaaaataaagccaataaacacatagttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgattttttcccatatttcttgcagatagtaaaatcaaatcttctcaggtatga

SEQ ID NO: 310009 - DNA, 4895 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310010 - DNA, 4188 bp, Homo sapiens
agcggcgttggtagtctgaccctaggtaatggtcaccgacgtcgtcttcaggcaccgaccgcctggctgtcttactacaaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310011 - DNA, 4856 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310012 - DNA, 2767 bp, Homo sapiens
ttaaacactgtgttttcagtggatgaatttaacacagatgggccacagcagagcacaggaaaaggaaattggaatacacatcgatagaagacacacagactgaagcacagagaggaaaaagaacagccaagaccaacaagagcataagaaacatgtggacacacacatgtctaagctatgtatagaattgaaattccagaagaatgaaagagcaagaatagcaatcaccggactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310013 - DNA, 5059 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcatccaacaacaacacacaaaaaaaaaacatgttgcgggcccgcgcccgaaaatttaaaccattgggggcgcgcgcccaagaaggaacagccaaacggccagagaccgggcggagggggtcccccaaaaaagcggggcgggcgaaccaggggggccgcttcacgcc

SEQ ID NO: 310014 - DNA, 2598 bp, Homo sapiens
  misc_feature (57)..(57): n is a, c, g, or t
  misc_feature (60)..(60): n is a, c, g, or t
aacgtacctactgcgataaactcggtccaacgagaagagaaggggggggctccaggnatnggactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310015 - DNA, 2642 bp, Homo sapiens
tttaggatttaccaactgaatgttgacttctttatgtatcactctctagttgctccaaacaagttatgattcttactttagatgaaaggagtggcagttaatgaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310016 - DNA, 2876 bp, Homo sapiens
cacatgactttttttgtttgttttttccacttctctagggttcttttccccagtcctttgtaaacatagattttaactactgttttcttcaaaatcgtataacttctcaatgaaaaactgtacttgaagacaaatcccacgaaatagtgtgatttgaagaaatgagtgtacttttaacctaaagagaaatgcaatgaaatattttcttgaaaaaaaacttgtaatattagtattaattttacaaaaaaagaaaactctgaataattccaaaaactatttgtagaatggatgaagcaatgcctgagattatagatgggcttggggacaatggagttttataaaaggccctcctgtaaagtaatttactaaattacttttagtacaaagtatctgttgatgttaaaaaattattgctttggaagcttatctaaattatttttttttcatttcagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 310017 - DNA, 4119 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatggga

SEQ ID NO: 310018 - DNA, 4058 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgca

SEQ ID NO: 310019 - DNA, 2740 bp, Homo sapiens
  misc_feature (2697)..(2697): n is a, c, g, or t
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcaaaaaaaaactaagagcagattgcgcaacgaatagacctaagttacccaatgctcacataacaaatattgaataaaccnccaaagttgagatcctgtggccccttgtggcctaaccggggga

SEQ ID NO: 310020 - DNA, 2236 bp, Homo sapiens
  misc_feature (2236)..(2236): n is a, c, g, or t
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtagccatcctaggacgtatgctggtatagacgtgactcaaaggactcgatgcgggccan

SEQ ID NO: 310021 - DNA, 2261 bp, Homo sapiens
  misc_feature (2224)..(2224): n is a, c, g, or t
  misc_feature (2228)..(2228): n is a, c, g, or t
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaccagaacacgtatgcggccgggnctcnttttactaatacgaatataagttaaattgggcg

SEQ ID NO: 310022 - DNA, 1562 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcatttgtatgtcagccttggttgtcttgtactccagtgtggagagag

SEQ ID NO: 310023 - DNA, 3040 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactga

SEQ ID NO: 310024 - DNA, 2509 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataa

SEQ ID NO: 310025 - DNA, 2425 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataa

SEQ ID NO: 310026 - DNA, 771 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcaggtgaggccgcctggggctcgggccgggatgggggtggcggcaggacctccgcccgccgccccaggagaccttttggaagggcctgggagaggggtcgtcctcggccattctcccgggcgtcgtcccaaattagatcacacccaagttcgtgggtttgcgccttgggacaccgcaatggtttgtggcgtggcggcgcggcctgtttgtgggacgggctgatgccgcttttctc

SEQ ID NO: 310027 - DNA, 806 bp, Homo sapiens
gtttattctgccagtgtagtagaaaatatatcttcatgaatgccagttactcccatttttctttcaatggcatatattcacgtttgttcaaggaaaagcctaagaaaatgattgcttttattttttaggatattgcatgtcattatcataaccaccattctcattgagagagaatatgcctcatttttttgtttttgttcttctggagatccctcttgtggacagtatcttcccttttcctttttttatttatgttctaccttcctcccttttaagtgccagctgaggcacttgggggaagatagaataaaacaaggtacattacttgtttcagatatttccagttaaaattgtttgaacacttgccccatagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccaggacgttggaacttgccaggaatccagcaatgatgcaggagatgatgaggaaccaggaccgagctttgagccacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacgaa

SEQ ID NO: 310028 - DNA, 3946 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310029 - DNA, 3990 bp, Homo sapiens
tagttcacaaggcacccacttaccaagctttttcacctttccaatttgcttcaaatgccgaacgactgtagaatggtcaatgttgagttcttcagcaacttcaggtgtagttataagaggatcagcttcgatgattgctctcaattggtcactgtcaacttccgatggctggccactatgctcctcatcttcaaggctctcctctcctttgtgaaacttcttgaaccaccactgcactgtgcgttcattagcagttcctgggccaaatgtgttgctgatgttgtgagttgtctccgctgctttatgacccattttgaacttgaataagaaaattgctcgaatttgctttttgtctaacatcatttccatagtctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310030 - DNA, 3888 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310031 - DNA, 4022 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttaaaaaaaacaaaaggcggagcgctaaatatccctcaagggcacaattagcgtaccgattcttgtcaaagggccctta

SEQ ID NO: 310032 - DNA, 5540 bp, Homo sapiens
  misc_feature (5070)..(5070): n is a, c, g, or t
  misc_feature (5084)..(5084): n is a, c, g, or t
  misc_feature (5086)..(5086): n is a, c, g, or t
  misc_feature (5089)..(5089): n is a, c, g, or t
  misc_feature (5093)..(5093): n is a, c, g, or t
  misc_feature (5099)..(5099): n is a, c, g, or t
  misc_feature (5102)..(5102): n is a, c, g, or t
  misc_feature (5105)..(5105): n is a, c, g, or t
  misc_feature (5113)..(5113): n is a, c, g, or t
  misc_feature (5115)..(5115): n is a, c, g, or t
  misc_feature (5118)..(5118): n is a, c, g, or t
  misc_feature (5165)..(5166): n is a, c, g, or t
  misc_feature (5189)..(5193): n is a, c, g, or t
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacaaaacaccacaccccccaacaaagggcggggcccgcctccaaaagtttcccccctcgaagggcgccccacacttttaaccgcgtttcccccaccttttcctgttgtctcccaccagcggtgcgcccccccctatcacgctcggcactctcgcgcctttcataacccctcagccgccatctgggcccccgctccgtcttttccaccccacgtgtccgtcgcactctgcgcgccaccacccttggtccatcccgctcggccggacacccattctcgcgtcacacggcgacccccttcacactcccgtgccgcgcgtgggtcgaccccctacacttccgccccccacacaccttaccccttaaccacagaccgactttttaacagccgcctctacacggcggctacaccttctctacaccgctctctctccacacaccgtcgctcttcacccggttcgtcacacacccttaacccttccgcattatatccgcctctcgcctccgccctttcgcaacaaagctctccgcgcccacaccctcagacctcttcttcaaccctttccatcgaccaccacactcttcttttttttacccccccagcgaacccattccccctcccacaaaaaaacctcccctcctccctaccaaccacccactacacccacaccacacacctcaacctacactcaccccacccacctccctccacatactcaccctcacaactcactacacccctctctcaccttaccacccacgaacccccactcactcatactgcagactcgacactccacacgcaccccatacaccccaccatcaccacccgcacctccctccaccactacctacacgccaactgctcagacaccgcgcgcatcaaccagtcagctcatcgccacagcactcgcaacaccacagcacgagcccgccaccgctacccacccctcccccctgcgccccacaccccctgcaccccccccacacgaccacacacccgcccccccctgcccactcacctcctccacctccccctccctccccacctccctccctcaccaccctcccctcatcaccatcaccgaccgcgcccccaccaccgaccctccccccccacatctccacncctccccccccccncncgncccncacccnccnccnccccctcncnacncccccccctccccctcaaccccaacccccctcctcccgcgccgccgnnaggccctctttggccccctctgnnnnnaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttc

SEQ ID NO: 310033 - DNA, 4282 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccgttcccaatttggccttatagggagcctttttacaattaattgcccgtgttttaaacaacgctaaatggaaaaaccctgggtttcccaaatttatatccttgtgaaaaaatccccttttgccaattggctttattgcaaaaagccccaaccatatggcttttcaaaaatttgcaaccttaattggaattggaaatttaagctaaaaattttgt

SEQ ID NO: 310034 - DNA, 3862 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310035 - DNA, 3907 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310036 - DNA, 3814 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310037 - DNA, 3415 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310038 - DNA, 2972 bp, Homo sapiens
  misc_feature (2524)..(2524): n is a, c, g, or t
  misc_feature (2534)..(2535): n is a, c, g, or t
  misc_feature (2537)..(2537): n is a, c, g, or t
  misc_feature (2541)..(2541): n is a, c, g, or t
  misc_feature (2545)..(2547): n is a, c, g, or t
  misc_feature (2552)..(2552): n is a, c, g, or t
  misc_feature (2560)..(2561): n is a, c, g, or t
  misc_feature (2566)..(2566): n is a, c, g, or t
  misc_feature (2571)..(2571): n is a, c, g, or t
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataaaaaaaaaaaaaaaanaaaaaaaaannanaaanaaannnaaaanaaaaaaannaaaanaaaanaaaaagccaacaaaacaacaaaagcacagacacagacaataaaaacgtcaccgccacaccaaaaacaccaccaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310039 - DNA, 2712 bp, Homo sapiens
gtttattctgccagtgtagtagaaaatatatcttcatgaatgccagttactcccatttttctttcaatggcatatattcacgtttgttcaaggaaaagcctaagaaaatgattgcttttattttttaggatattgcatgtcattatcataaccaccattctcattgagagagaatatgcctcatttttttgtttttgttcttctggagatccctcttgtggacagtatcttcccttttcctttttttatttatgttctaccttcctcccttttaagtgccagctgaggcacttgggggaagatagaataaaacaaggtacattacttgtttcagatatttccagttaaaattgtttgaacacttgccccatagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310040 - DNA, 2181 bp, Homo sapiens
tttgcaggaccttaggatatttcctatttgtgctttctgtaggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310041 - DNA, 2292 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagattatgctga

SEQ ID NO: 310042 - DNA, 1247 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaatcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagctttta

SEQ ID NO: 310043 - DNA, 1868 bp, Homo sapiens
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaacttatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccaggtgtactcctggctgggggcattaggaagattgctaggggtaaggaagctactagggtaagg

SEQ ID NO: 310044 - DNA, 1135 bp, Homo sapiens
  misc_feature (1133)..(1133): n is a, c, g, or t
gggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacaacgttttggaactttgcccagaatcccaccaatgatgccgaaaatgaagaaaggaacccnga

SEQ ID NO: 310045 - DNA, 2515 bp, Homo sapiens
tcggacgagagcgccccggggagctcggagcgcgtgcacgcgtggcagacggagaaggccagtgcccaggttagtgagcagtgcccggcgcccgcttccctcacctccttttccagcctttgcacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctctctcacagacacacacacacacacacacacacgcacacgcacgtccacactcacattaaactaaagctttatttgaagcaaagctagccaaaattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaat

SEQ ID NO: 310046 - DNA, 3845 bp, Homo sapiens
tcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctctctcacagacacacacacacacacacacacacgcacacgcacgtccacactcacattaaactaaagctttatttgaagcaaagctagccaaaattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 310047 - DNA, 3903 bp, Homo sapiens
tcggacgagagcgccccggggagctcggagcgcgtgcacgcgtggcagacggagaaggccagtgcccaggttagtgagcagtgcccggcgcccgcttccctcacctccttttccagcctttgcacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctctctcacagacacacacacacacacacacacacgcacacgcacgtccacactcacattaaactaaagctttatttgaagcaaagctagccaaaattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 310048 - DNA, 2720 bp, Homo sapiens
aagagagagatgtacaagagaagagacgatctgtgccctgtcccagtcctggcccccttggttttgaccattaaggtgtgtggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctctctcacagacacacacacacacacacacacacgcacacgcacgtccacactcacattaaactaaagctttatttgaagcaaagctagccaaaattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 310049 - DNA, 2266 bp, Homo sapiens
tcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 310050 - DNA, 3271 bp, Homo sapiens
tcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctctctcacagacacacacacacacacacacacacgcacacgcacgtccacactcacattaaactaaagctttatttgaagcaaagctagccaaaattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacacacacacacgcacgtccacactcacattaaacgaaagctttatttgaagcaagctagccagattctacgttacttttcccttgactggatcccagtagcttggaagttttgtacccacgagtgtctgtctt

SEQ ID NO: 310051 - DNA, 1708 bp, Homo sapiens
tcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 310052 - DNA, 944 bp, Homo sapiens
gtcttgaaactatattattcattctttaaagtctgatacatatgtgtagtgcaccttaaacacagttggaatgctgtatcaggtgtaaatataatccatagcacttacaatatcttgccagctactttattcagtccaaaaggaaaatatctgttgagacaagcaataagatatctctatgtaggacacagagactccatttactggtagacaaagggcctggtttgttgaaaaaagactccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaaggtaagttagtcatgcttttgtattgcgtttcatatt

SEQ ID NO: 310053 - DNA, 943 bp, Homo sapiens
tttattactactaaattcgcggccgcgtcgactaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaa

SEQ ID NO: 310054 - DNA, 2867 bp, Homo sapiens
aagtctcaatgtttaaggaaaaaagatttagaaatagtggtttttaaaagtttgatggaaaaacacatgagttcctgctggtgcattttacatgctttctaggtccttctgagttttaggatcctgagggatttggttggtattgtttttgggttttcttcttgaaactcagtattaaaacactgaaaagtagcagatttttttctacctagagttttctgtttatccatcatgagcccaaataaagtcacaattgtatgttacctgctttacaaagaagccatttatgtttaattgactgttcattttgctttcttgtctgctgggatgacaaccgtgaaattcagtctggtagtttttatgagttggacatgaacctattagaaatgatttaaagtataaaatcatttctcacaggctttcaaaacataaacctgtgatcagaaacctggaatctagaaatttattcaggacttgcagaatttgtagcatatctacattattggagatctattgaaagggcaagaaaaagatgattgcccgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagtgaaaactgcccttacagaaaagaaaatgagtttataaagatttctcacagagttcagtggaaaacggttttactgtaagagagagtttaatgaagaagaatcaaagcttattaaatttttcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgca

SEQ ID NO: 310055 - DNA, 904 bp, Homo sapiens
ttctttatcatctgactctcctattactatctcctcctcccattagttctttctttctcatctattctctcactttctatatttctttcccactataccttcttttaccttgcctggatgctcatcttcattcccacgtcacttatgttcgtatctctcaccaacctatacgtgaactattgtttctgcctccgaagccctcctgtcctttcttcgctcgccctctctgctcgtatatttagtctctcgacttcgccgattggctcgttctggtatgcacataattgtgtctgttcctttttctcttcctcttccctctctcttctatttctctcgcccctccccctccgcttcctttctctttcttccttcctccctccttttcttcctctctccttttttttccttctctcttctcctttctttttctcttttctttttctttttttttttttttttttttttttttttcctttcttttttttttttttttttttttgttttctttttttttttaggtttgagggggaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaa

SEQ ID NO: 310056 - DNA, 408 bp, Homo sapiens
tgtgtctgtctctgcctggctccataaaagcaatggaggcagcagaatatccagacacagtttttctctgctccatgccccctctatgcatgcagtcaccatctttttagcaatacaccattaactctggaatattcactgacagtctgaaagatactaacatactcaccatttatttctccttgccatcacttttatgctcagttttgggggtctccattttgttttctcttcaaccatgaattcatattgtttagaaagtttctttgaattctgagagagaatgagaaattagaagagaaaatcaagtgagaaccccatgccttatttaattgaagagtttctcccccttcacctcctaaagaggaatagtagagagtttccacccatatgtaaagaagtggtgtt

SEQ ID NO: 310057 - DNA, 4158 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgca

SEQ ID NO: 310058 - DNA, 4412 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310059 - DNA, 4353 bp, Homo sapiens
cacgtcaccggcacgggagcgagctgttctgctctcccgctctggactggagcaaagcttcccccaccctggagtgcccacagtagccaacacattgctttgcctgctacagatgctcaagtgatagttgtggagtgaaattatataagctcctcgcatgcagggcctgaggcattgctgagtccttcgtttgaacacactgcaggctcagaagaaaacctttccatgctttacatattgcacagccatgaccaacccctgcacatgctccagcctcacatgttctgccacagacaaggtagagccgagctcggctctaccttgtctaatgaatagagaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310060 - DNA, 4357 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310061 - DNA, 3709 bp, Homo sapiens
  misc_feature (23)..(23): n is a, c, g, or t
ctaacacaggatacctacctggngcaatttcctgacataaagaatcgcatcgccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310062 - DNA, 3646 bp, Homo sapiens
gaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggtgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310063 - DNA, 4358 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgaatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310064 - DNA, 5404 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310065 - DNA, 2906 bp, Homo sapiens
gactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310066 - DNA, 4484 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310067 - DNA, 4363 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaaaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310068 - DNA, 4374 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310069 - DNA, 4335 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaattt

SEQ ID NO: 310070 - DNA, 4301 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310071 - DNA, 3099 bp, Homo sapiens
acatgttatacagtagccctgctctctcctggccaaagacacacctgcgagagaagtaaaacaagaacaaaagctcctgtttgttttatattttgaaaataatgtagcctaaggtaaaatgcaactccatttatgaagaaatcagaatacatagtgttctgttgggttgcttaggaaggttagcatggctgtggcacagtcttccaaatacatttttcttattgagccaatcccttgagtgcttcttttcctgatgcaacttttcttctaaaatgtgtgctaaaggccagatgtgagcaccctttgcatattcaactactgtactttgtttcttcttctgctaacagtattctttaatgtgattggtatcctgtgtcattttttctagttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310072 - DNA, 4357 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310073 - DNA, 4224 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaattt

SEQ ID NO: 310074 - DNA, 4356 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310075 - DNA, 1663 bp, Homo sapiens
ccgttctgcaggaattcggttcgagcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310076 - DNA, 1609 bp, Homo sapiens
  misc_feature (35)..(35): n is a, c, g, or t
ggtgcctgtatctatgaatgacctcggccaggagncaacatgactctagagtatttacagtgtcaccaggttgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310077 - DNA, 3474 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcccaaaggacccttgatcaattctgaattctatactggctggctagatcactggggccaacctcactccacaatcaagaccgaagcagtggcttcctccctctatgatgta

SEQ ID NO: 310078 - DNA, 2978 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaa

SEQ ID NO: 310079 - DNA, 634 bp, Homo sapiens
ttccgcgatcgctcgcaaaactctccctccctttccctccttcccagccaggagacatccccacctgggacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310080 - DNA, 2237 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgatttgatgctgacgacggggatcctctggaacgatatgcaccctgatacga

SEQ ID NO: 310081 - DNA, 2376 bp, Homo sapiens
caaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggaggtttggaaattcataccctcaacaccacattgtcatttgccctcattcctcataacacattgccattgccaaaatcttggtattttttaacttttctgataataagcaaactcttgctatttgagtacatttttaaatttccaaaataaataccacaagtatgtgtgattttgtgaaatattgatatatgggatttggatttagggaatcaa

SEQ ID NO: 310082 - DNA, 1206 bp, Homo sapiens
gtcttgaaactatattattcattctttaaagtctgatacatatgtgtagtgcaccttaaacacagttggaatgctgtatcaggtgtaaatataatccatagcacttacaatatcttgccagctactttattcagtccaaaaggaaaatatctgttgagacaagcaataagatatctctatgtaggacacagagactccatttactggtagacaaagggcctggtttgttgaaaaaagactccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310083 - DNA, 559 bp, Homo sapiens
attcagagtgctgccaaaagcactagcactcagggcttggagcatgacctggatgatgtcaatgcacggtggaagactctcaataagaaggtggctcagcgagcagcccagctgcaggaggccttgctgcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaatac

SEQ ID NO: 310084 - DNA, 1072 bp, Homo sapiens
gaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaaaaaaaaaa

SEQ ID NO: 310085 - DNA, 745 bp, Homo sapiens
gaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaaaaaaaaaa

SEQ ID NO: 310086 - DNA, 95 bp, Homo sapiens
gaccaggatgggaaaataacgcggcaggaatttattgatggaattctttcctcaagtaagttccaagacagatgactatgactgatacaattttt

SEQ ID NO: 310087 - DNA, 397 bp, Homo sapiens
aattgaagagtttctcccccttcacctcctaaagaggaatagtagagagtttccacccatatgtaaagaagtggtgttagtggaatatcatggtacaggagcaatattttgaaatgtcttgttgctggttaaatacaggaacgccaatacaaggaagcaagcttcgacttccaggatatttatcagggaaaggcttccactctggggaggacagtggcttgataacaactgcagctgccagagtccgaacacagtttgctggtgagtgtggtgcctttcttttttcaatggcttttgcagcatggtcatctgaggattaaagtcccttttcctcctcattggggaagaaattacaaattgaccctgaggtagtcttaaaatgatatgtagccccagt

SEQ ID NO: 310088 - DNA, 421 bp, Homo sapiens
gaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatat

SEQ ID NO: 310089 - DNA, 746 bp, Homo sapiens
aaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtg

SEQ ID NO: 310090 - DNA, 1002 bp, Homo sapiens
taaatatttatttattttttcagcttgagtctcgccctggcgacagagtaagactccgtctcgggggaataaaaaagctctatatttgatacttattgaaaacgaagtataaggatattctttctctttacagattggatttacatttagtgtgcctgttgcaaaaacagcagaactttctggttctagtagtactttagaaccaattataagtagttcaggtaagtaaaaatttcttacattttaacatacaaacaattgcatacagtagattagtatttcagcttctttcacctttggtaattcttataaatgccttcatttggatgaaattagctctgaaaagcaagcaggcactattatttaacctttttgacggtgctttttattaattatctttagagatacttagctccttaaatggaagtgtcagtttggttttgagagagataggcatggtagcaaatttatccactatctttgtttagtcaaaacaaggtgacaagttagttataaagcaagtctcattataagaaatttataggttgtctacattatagttgtagtagattttatttctagtttttacctttcagttcacaagcatttttatgtataaaggttatgcaggcccatgtagattgtgatacataatttctgaaccgaagaaatcagcatcattgaaggaaggaggccatgggtcattcctgtaaacccagcagtttgggaggctgtggtgggaggattgcttgaggccagaagctcaagacgatcctaggcagcacagtgagactcatccctaccgaaaaaaaaaaaaaaagaaaaagaaataaccaggtggtggtgtgagcctgtagtcccagctacctgggatgctgaagtgggaggattgcttgagcccaggaattcaaggctacagtgagctatgattgcactaccacactacagctggctgacagagcaagaccctatctcaaaaaaaaagaaagaaatgaatgaata

SEQ ID NO: 310091 - DNA, 1427 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcaggtatgggaccccgacgccgcggtggcctggcgggtggggaaactcggctggaggggacgggcggttcgaggccccggcgccccacgtggagcagacaggagggcctgaggaaaggcccgagtgaggctccgggggagctcaggccgttgggggtggcgacgggaagtgggctgagacaggcccagccttgcggcgcacacgtgtggtttgggccgcctttcccccaactctctgggtcaggggctttcccaggcaggctctgggcgggaaaagaaattgtaggcccatgatgcgcgcgtttctttattttttggcggggatttggaatttgagggtattactcatgttct

SEQ ID NO: 310092 - DNA, 843 bp, Homo sapiens
taaccctataatgtaataaaggttatatgaatgtagtctctttctctctcaaaatatcttattgtatataatatctttggatcatggttgaccatgggtcagggaaactggaaattgaaaccatggataaggtaggctactatatataactttatgtttcatattagtacaacaactgtagtatatcgtaagaattactatcttttttccctcagttttaccaattaggaaattggtacagaaggcagttaggttccccaagtcaaatggctggttggtggcacagctgggattaaaaatcatgttcagtttttctgattgaagaacccataatgttaacactacatggtaccatcttcttcctgtatactttcatgctgaaaataagtagagataaaagaatgatgtgaaagatgaaatatatcatgcaacatgttatgttttaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaaaccattatataaatacaggtgacatttgttctttcttaattctttatttaaaaaaaaccctatattataaacagtgtttaattttcattatggaaattaataacatagtaaacagagaaatggaaatgctgttttgcttttttaaaaaaatgtacaaatatcttggatacattataatggagtgttcctcaactcttatgcaataccatagagaaggatattcttgtaaatttgtttccaaataatgtttcc

SEQ ID NO: 310093 - DNA, 6455 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310094 - DNA, 6349 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310095 - DNA, 6401 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctgtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310096 - DNA, 6239 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310097 - DNA, 6182 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310098 - DNA, 4340 bp, Homo sapiens
tgattgaccgaatttctggtgttcgattgtcaggagactaatcaaagaatagactacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310099 - DNA, 6800 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtaagagaattttttattgaaatggagaagttacattggtaagggtatgtgcatgtatatgttttgtttttaaaagtcatcaagattccgtatggtttgggtaaaattaaatatgttctccaacataaatttaccatactataattctggaggattatattacagtttgagaaaaaaataacagtagcgtgtgtgttaggtatagcagaaaatgtatataccaatgtgagtctactccccccccacccgaccccccttacccttctgctgctcatggtaaatgttagcatttggaaattttgctcagagcatcatgtcacattatgaagtttttatttttcacaggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310100 - DNA, 6522 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaa

SEQ ID NO: 310101 - DNA, 6619 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacataaaaaagcaaagacaagagacaagaagagaacaccgtctggcggcgccgtgagccccagaagaaagcttcaagcaacaagtggagaggggcgggcccaacagaagagagagaccggcagaaggagaacccaagaaaaccggaagcaaaagggagggaacccacaa

SEQ ID NO: 310102 - DNA, 6097 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctacttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatctgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaattttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacata

SEQ ID NO: 310103 - DNA, 3468 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgcctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcaggtaagtaaaaatttcttacattttaacatacaaacaattgcatacagtagattagtatttcagcttctttcacctttggtaattcttataaatgccttcatttggatgaaattagctctgaaaagcaagcaggcactattatttaacctttttgacggtgctttttattaattatctttagagatacttagctccttaaatggaagtgtcagtttggttttgagagagataggcatggtagcaaatttatccactatctttgtttagtcaaaacaaggtgacaagttagttataaagcaagtctcattataagaaatttataggttgtctacattatagttgtagtagattttatttctagtttttacctttcagttcacaagcatttttatgtataaaggttatgcaggcccatgtagattgtgatacataatttctgaaccgaagaaatcagcatcattgaaggaaggaggccatgggtcattcctgtaaacccagcagtttgggaggctgtggtgggaggattgcttgaggccagaagctcaagacgatcctaggcagcacagtgagactcatccctaccgaaaaaaaaaaaaaaagaaaaagaaataaccaggtggtggtgtgagcctgtagtcccagctacctgggatgctgaagtgggaggattgcttgagcccaggaattcaaggctacagtgagctatgattgcactaccacactacagctggctgacagagcaagaccctatctcaaaaaaaaagaaagaaatgaatgaata

SEQ ID NO: 310104 - DNA, 1966 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacttcttatctattctttgattagtcttcctgaattcaccagaaggagtcagagatggtttaaaataaacacttcgatttgttgctatggaaactggctcctcgtgc

SEQ ID NO: 310105 - DNA, 1603 bp, Homo sapiens
agccgtatttattttctaattctaaggatcatggactttatttttcaaccacagatttttttttcctccttcttaaatcattagctcttgtctttgattttactgtctgcttacttcctgcctacttaaccaaccgacagggagaaggagaatgggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcaccaagaccctgagcaatctcaattacaacatatacaccaacaaacaatgttcaaccagtaactactactaatcaacgcccataatcatacaaagcccacgcgcaaatagtaat

SEQ ID NO: 310106 - DNA, 2862 bp, Homo sapiens
ttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310107 - DNA, 3065 bp, Homo sapiens
ttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaaaaaaaaaaaaaaagaaaaacagacaaaagaggggggcggaccgactccgaaaaaattatcgccacggagagggggaccccatatgttagtgccggctttacccacagtatgttgtggtgacacaagagggtgccccccattatggggcaatcgctttataacagcataggagatttgggccgtaattatacagacagtccag

SEQ ID NO: 310108 - DNA, 2315 bp, Homo sapiens
aagtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcgtgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagagggaattgtacttagagtgctgtgtgtgggggtggggatggggaaggacataacttttaaaccgagacttgtgggctggagaggaaggagccagtcctggacttggggaagagtgttcgcggtggatggaatagcacgtggagagtccctgagatgggaaggagctcagtgggctggaggaatggcgagcaggccagtgtggctggagcttagtgaggtgcaagaca

SEQ ID NO: 310109 - DNA, 1710 bp, Homo sapiens
gaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310110 - DNA, 3561 bp, Homo sapiens
aagcttgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310111 - DNA, 3594 bp, Homo sapiens
tgctgggggagagctgggttttcatggggcggcagccgaggcaggacccgcagccatgaaccgcttcaatgggctctgcaaggtgtgctcggagcgccgctaccgccagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310112 - DNA, 2658 bp, Homo sapiens
aacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310113 - DNA, 2495 bp, Homo sapiens
gtctggggaaggcagccgcttgacacggccgccaggagctgccacagccacggccgcccgcctgcgggaggagccgggtggaaacctgggcgggcgagctggcaggagcggcagccaggagtcgcctgggtccctgctggagtatgctggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310114 - DNA, 2482 bp, Homo sapiens
cactttcactttcacactcccaggctgtggctcttacccgtgccgagctttcacatccgctcacatctgtgctcccagatgccagcgtgacccctgacacgtgtgtgcagcagcctgcagctgccccaagccatggctgaacactgactcccagctgtggggcttcaccattacagactccccaggggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310115 - DNA, 1913 bp, Homo sapiens
gaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaaaaaaaaaaaaaaagaaaaacagacaaaagaggggggcggaccgactccgaaaaaattatcgccacggagagggggaccccatatgttagtgccggctttacccacagtatgttgtggtgacacaagagggtgccccccattatggggcaatcgctttataacagcataggagatttgggccgtaattatacagacagtccag

SEQ ID NO: 310116 - DNA, 1591 bp, Homo sapiens
cgttgtgagggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacaggagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310117 - DNA, 1658 bp, Homo sapiens
gaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgagagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310118 - DNA, 1642 bp, Homo sapiens
  misc_feature (154)..(154): n is a, c, g, or t
cggtgcagctcgtgcaccgttgctggccgctgcccaggacactggggctgagttgtgacagagagccaacgagatgcgatgcctcctgacagtaccacgtctgtgcgcctcccatggtgcggaggtcctacaggagtatgcattccgaggtgantgtaaccgtcacatcgtgcaatggagaaacctgtccacaggtgcagatcaacacagattaaaggatgctaggatgcccttcgtgcccaagtctactccctgatctcgtgtgagtgtcgtaagggaggcgagcatgggccaaggatgcacgcaacacgtcatttgtcttgctgtctgcttgccatgtagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 310119 - DNA, 1494 bp, Homo sapiens
gaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttattaacacgcagtgggtcgtggacgttcgtatagaacctgcctagatcggttaagggcgattacagctggaactcgcgcaagggacctcagatcggaattccgggcagggaaggtctaaaacggggagccggaaagccgaggagac

SEQ ID NO: 310120 - DNA, 1122 bp, Homo sapiens
ttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcactcacccaccacattaacaacataaaaccctcattcacccgagaaaccccccta

SEQ ID NO: 310121 - DNA, 1307 bp, Homo sapiens
aacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcgtgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagagggaattgtacttagagtgctgtgtgtgggggtggggatggggaaggacataacttttaaaccgagacttgtgggctggagaggaaggagccagtcctggacttggggaagagtgttcgcggtggatggaatagcacgtggagagtccctgagatgggaaggagctcagtgggctggaggaatggcgagcaggccagtgtggctggagcttagtgaggtgcaagaca

SEQ ID NO: 310122 - DNA, 748 bp, Homo sapiens
gtgagaaagctaaagggggagggagaaggatacatgcaatgtggggagggctggcccaggggctgcagggaatgagaagtcaccatgttccacccccactatcctggcagcctcccagcgaactttccacctgttggacagaagataaaactgaggcccaatgggaccaagaaggcagagcatggacttaaacacatgactttaggattccagatgctgtgttcttatagctccactggtccccacagaaagcagagcaggtgtagcttagcccaggccattgtgtatttggatttaaaagatctgagatagtagctggagaaatagagttacagcctagccagactagaaatccatcagccagtcacaatgacaacacacatttattccgtgtccacattatcctaagcagtttacattaactcattaactctcacaacagccctttgaagtagatagtatttttgtgcccattttacagcagaggaaaccgaggcaaagagaggttatctaacttgctccaggttacacagtgtatcagtgtctgaactagaattagaatctggttccagggccagtgctcttaaccaaccaccacaccgtttgcctctcgtgaatatttatatgtagatgaataagtatttatggatttcctgctgtgtaccaggccctgcgctctgcaacatggcaggagccacagaagtgtgtgaggctggtctcaacctgagagaaataagttaactgtgtg

SEQ ID NO: 310123 - DNA, 1494 bp, Homo sapiens
cggccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310124 - DNA, 249 bp, Homo sapiens
gactacttcaaaatagaaaaggaattcggggcgagccagagagggcccacacgactagaaggacgactgcctggcgcgatacaaaaatggtctccttgtgttgcccgggctggtctcgaactcctgacctcaagtgatctgcctgcctcggcctctgaaagtgtggggattacaggcatgacccgtcacaccgggctggaatgcacggatcttatatgctacaaattaaagaatcttcacagctacgca

SEQ ID NO: 310125 - DNA, 1839 bp, Homo sapiens
cggccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttccaaacggtgtgtcccggtgtaattccctttggacggcagctcccctccccgccacgccccgtgctgcagctggagcagaggagctcacgcctgcgggtcgggaggcgcatccgtggaccatgggggcagctgggccacactgtccttcgccctgtggcctgctagcctggtcgagagaggtggtggggttctctggaatggtttcctcctgacacccagagctgtgcggggaggcagggatctctcatctcacagagattgtgcctgggggagcgtggaggcagggcctccaggtgctggaacagtcgggaggggcagcatcatggtgctcggtcagccgaggaga

SEQ ID NO: 310126 - DNA, 1448 bp, Homo sapiens
ccgggggattggtgggacggatggctctgatgtccttggctggctccgcttgtcccttgactctgatttgagtcagaggaaatcatctgagcgatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310127 - DNA, 1443 bp, Homo sapiens
gactacttcaaaatagaaaaggaattcggggcgagccagagagggcccacacgactagaaggacgactgcctggcgcgatacaaaaatatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310128 - DNA, 1462 bp, Homo sapiens
ctcggggctccttcacccctgccccgagccttcccctcttgcctgggcgacttccatgcaccctgggctcccatcaacccttacctgcagctgctcgctcatgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310129 - DNA, 1674 bp, Homo sapiens
gctgcataggatatcttgagccagtctctcatccgtagaggacacgaatcacttcaaagtccgtacaagtcggaacagattttgccagaatttgtggttagcaagaaagtgatgtgttccgggtaggggaattctgttttggtattattttgtctttcctgagaaaagcatcacaaaaagagatgtttgcccatcctgtttgctggggtagtgggaagagaccgggggtgatggtggtgctggctggacgtgggtggtttcacaggacctgctgtgtctgagaggagccatgcggtgattagaagcttggaggctgcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310130 - DNA, 1155 bp, Homo sapiens
cggccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcagatctgccgacaccccaggccatcgagccccaggccatcgtgcagcaggtcccagcccccagtcgaatgcagatgccgcaggggaacccgctgctgctgtcccacaccgatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcgtcgcgggccatcgacaatgcggcagatcttctcatattcgggaaggagctaagtgcaatagggtctgacacgaccccgctgccctcctgggccgctctgaatagcagcacgtggggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcatcgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310131 - DNA, 414 bp, Homo sapiens
tctcgggccctgtcacactagtttctgagattcaaatttctcacaatgttccatgccaagttcatatggtccaactcctccctagtacgatgatgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttcc

SEQ ID NO: 310132 - DNA, 2743 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310133 - DNA, 2645 bp, Homo sapiens
tgtacggtccgggtatttttatttcgaccagcggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310134 - DNA, 2659 bp, Homo sapiens
tataaggctaggtaagctcgtgttaattggcgaggcctggatcaccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310135 - DNA, 2650 bp, Homo sapiens
gagcgcacgatagggctaggacgaggccgggtgtgacggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310136 - DNA, 2601 bp, Homo sapiens
  misc_feature (17)..(17): n is a, c, g, or t
aacggccaggctggtangcgccccggattttaggcatcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310137 - DNA, 2808 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaaaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310138 - DNA, 3203 bp, Homo sapiens
  misc_feature (2757)..(2757): n is a, c, g, or t
  misc_feature (2763)..(2763): n is a, c, g, or t
  misc_feature (2766)..(2766): n is a, c, g, or t
  misc_feature (2895)..(2895): n is a, c, g, or t
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggaaaaaaaaaaaaaanaaaaanaanaaaaaaaaaaaaaaaaaaaaaaaaaaaaaaaaaaaaaaaaaaaaaaaaaaaaaaaaaaacaaaaaaaaaaaaaaaaaaaaacaaaaaaaaaaaaaaaaaaaaaaaaaaaaaaaaaaaaaaaaaaaaaanacctggggggggccccgggcccaattggcccctaatgggggggcgtaaaaaattagggggccgggttttaacacgttgggaaggggaaaaacccggcggatacccatataaagccccggggggaaaaccccctttttccacgggggggatattgcaaaaagcgcccgccatgtgcccttttcaaaaaggtggccaccttattggaagagggcaatttaacgccttaaatcttggaaaatcccgggaaacttttggaaaaaagctctttttaaccacaagcgccaatgggggaaatccctcttaaataa

SEQ ID NO: 310139 - DNA, 2614 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaaggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310140 - DNA, 2725 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggcccggggggtcctagggccttagcgatctgaggaagggggggggtctgaaggcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310141 - DNA, 3201 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccgtaggacatgccccgtgttgttctaaggcctttgctttctgctcgttacataaatggtgaagaagagaagcgggtaagagaacagattggagccatctaaaagttctcatcttaagtgtagatc

SEQ ID NO: 310142 - DNA, 2728 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaatatatagagcaggagagtttccttttca

SEQ ID NO: 310143 - DNA, 2689 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaacccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310144 - DNA, 2633 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310145 - DNA, 1978 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagtaggtgctggccagagggcagcccgggctgacagccattcgcttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310146 - DNA, 2310 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaaacatttggggtcctgctcattccttcagcctcaacttcacctggagtgtctacagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcaaagttctgggattacaggtgtgagccactgtgcctggccggccttatcagtttttatgtaatttgtcctgatt

SEQ ID NO: 310147 - DNA, 2379 bp, Homo sapiens
gctcaggccccgcccctgccgccggaatcctgaagcccaaggctgcccgggggcggtccggcggcgccggcgatggggcataaaaccactggccacctgccgggctgctcctgcgtgcgctgccgtccccggatccaccgtgcctctgcggcctgcgtgcccggagtccccgcctgtgtcgtctctgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagttcaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaaacatttggggtcctgctcattccttcagcctcaacttcacctggagtgtctacagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattgatctaaatctgggatgactggccaggtgcggtggctcacacctgtaatccagcactttgggaggccgaagcaggtggatcatttgaggtcaggagttcaagaccagcctggccaacatggtgaaaacctgtctctacta

SEQ ID NO: 310148 - DNA, 2166 bp, Homo sapiens
gccttatcagtttttatgtaatttgtcctgatttaaaaaaaaaaaaatcacatgcgggtaaactcaacatattttaatttctctttagagaaattttccacttgagccaggtatggtggctcttgcctgtggtctgagctgctcgggaggttgaggtgggaggatcactgcaacctccacctcccgggttcaagtgggagcctcagcctcagcctcagcctcagcctcccgagcagttgggattacaggcacctgccaccatgcctggctaatttttgtatattgagtagaggcggggtttcaccatgttggccaggctggtcttgaactcctgacctcatgatctgccgccttggcctcccaaagttctgggattacaggtgtgagccactgtgcctggccggccttatcagtttttatgtaatttgtcctgatttaaaaaaaaaaaatcacatgcgggtaaactcaacatattttaatttctctttagagaaattttccacttgagccaggtatggtggctcttgcctgtaatctgagctactcgggaggttgaggtgggaggatcacttgagcccaggagttggaggctgcagtgagccatgatcgcaccattgcactccagcctggacaacagagtgagatcctgtctcaaaaattaaaaaaagcagtaattttttcttctcaagtcattcttttaaaataaatcaaaagtattttaacagaacaatctgttcctcgttgattttaaacagccccccagctaagtccactggttgtcggtctccatggcccatctccccaccttgcttcctcgctggcttaaattttcaagtggacgagcccttttcagcttggcttgtccacctcccaggtgtgtttcctgaagatgcttgtacttatgtctaagagcggcagctccccacatctcagccacctgcaatcgttgagggttgttggactctaaacttatgtgcctttcctgtttcctctttgccttttgcaaattgaagaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310149 - DNA, 2049 bp, Homo sapiens
acttgtattctgtggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattactcccaaagttctgggattacaggtgtgagccactgtgcctggccggccttatcagtttttatgtaatttgtcctgatttaaaaaaaaaaaatcacatgcgggtaaactcaacatattttaatttctctttagagaaattttccacttgagccaggtatggtggctcttgcctgtaatctgagctactcgggaggttgaggtgggaggatcacttgagcccaggagttggaggctgcagtgagccatgatcgcaccattgcactccagcctggacaacagagtgagatcctgtctcaaaaattaaaaaaagcagtaattttttcttctcaagtcattcttttaaaataaatcaaaagtattttaacagaacaatctgttcctcgttgattttaaacagccccccagctaagtccactggttgtcggtctccatggcccatctccccaccttgcttcctcgctggcttaaattttcaagtggacgagcccttttcagcttggcttgtccacctcccaggtgtgtttcctgaagatgcttgtacttatgtctaagagcggcagctccccacatctcagccacctgcaatcgttgagggttgttggactctaaacttatgtgcctttcctgtttcctctttgccttttgcaaattgaagaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310150 - DNA, 982 bp, Homo sapiens
cccagctttgcctttctccacagggtcctgaggacaccgtgagccagccaggcctggccgctgggcctgaccggccccccagcccctacaccccgcttctcccggactctcccagcggacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggga

SEQ ID NO: 310151 - DNA, 1748 bp, Homo sapiens
gccttatcagtttttatgtaatttgtcctgatttaaaaaaaaaaaaatcacatgcgggtaaactcaacatattttaatttctctttagagaaattttccacttgagccaggtatggtggctcttgcctgtggtctgagctgctcgggaggttgaggtgggaggatcactgcaacctccacctcccgggttcaagtgggagcctcagcctcagcctcagcctcagcctcccgagcagttgggattacaggcacctgccaccatgcctggctaatttttgtatattgagtagaggcggggtttcaccatgttggccaggctggtcttgaactcctgacctcatgatctgccgccttggcctcccaaagttctgggattacaggtgtgagccactgtgcctggccggccttatcagtttttatgtaatttgtcctgatttaaaaaaaaaaaatcacatgcgggtaaactcaacatattttaatttctctttagagaaattttccacttgagccaggtatggtggctcttgcctgtaatctgagctactcgggaggttgaggtgggaggatcacttgagcccaggagttggaggctgcagtgagccatgatcgcaccattgcactccagcctggacaacagagtgagatcctgtctcaaaaattaaaaaaagcagtaattttttcttctcaagtcattcttttaaaataaatcaaaagtattttaacagaacaatctgttcctcgttgattttaaacagccccccagctaagtccactggttgtcggtctccatggcccatctccccaccttgcttcctcgctggcttaaattttcaagtggacgagcccttttcagcttggcttgtccacctcccaggtgtgtttcctgaagatgcttgtacttatgtctaagagcggcagctccccacatctcagccacctgcaatcgttgagggttgttggactctaaacttatgtgcctttcctgtttcctctttgccttttgcaaattgaagaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattgatctaaatctgggatgactggccaggtgcggtggctcacacctgtaatccagcactttgggaggccgaagcaggtggatcatttgaggtcaggagttcaagaccagcctggccaacatggtgaaaacctgtctctacta

SEQ ID NO: 310152 - DNA, 541 bp, Homo sapiens
ttcattttgagtttaaaattttgttttatgaaatggaaagtgataatactcttggtgggcttataaattgggaagagttttggattacccctgaaacgtctctggaagcttctgttaaccctcttttttttttttttaaagtcagacaatggtatataacttttaactctcgataggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcaggtaaaacctgtctgcctcttttcatcttaattgtttgaatatggtagtttgagatttatgagtttattttactttattaaaaacatgttcaaagattac

SEQ ID NO: 310153 - DNA, 4055 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaaaaa

SEQ ID NO: 310154 - DNA, 4091 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaaaaa

SEQ ID NO: 310155 - DNA, 4106 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagatcagagttgactgcaataatgaaaggagtgtccacactaaaacattacagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaaaaa

SEQ ID NO: 310156 - DNA, 3942 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgctaaattgatgttgatgcaatccttacaaatgattgcttttaaaattttaagctaggaaaagaaatctatagaaagtgttctgttacaaaatgtaactgttaccattggaaatttcacgtcataggaagttagcctttatctaccaactttcaagaacttgtttaataaagcgaaaaactcaaccaaatggtacaaaaccacagtgtaccattaaaatatgcactaagtctcttttttacaaaggctgtattcagcaaggcgctaacttgcttaaatgtgaattactaacttctaaaactgtactttgattcacatgttttcaaatggagttggagttcattcatattacaatatttgtgtgctaaacgtgtatgtttttcagttcaaagtcatgatgtttttaaaatcttattaaagtttcaaaaatctgaagattgtttatctagatgtaaatttttattaaaaagttgcacttatgaaaaagcaaaaaaaaa

SEQ ID NO: 310157 - DNA, 3563 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaagtattgccaaacattaatgttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgcta

SEQ ID NO: 310158 - DNA, 3450 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaatacctccagtgaaggtagtcggctgcgcacgggtaaagatcgtaaccagaagaaagagaagccagacagcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggaccctgaaatgtgtgtgatgtgacatttgtcattttcattagcaaaaaaagttgtatgatctgtgccttttttatatcttggcaggtaggaatattatatttggatgcagagttcagggaagataagttggaaacactaaatgttaaagatgtagcaaaccctgtcaaacattagtactttatagaagaatgcatgctttccatatttttttccttacataaacatcaggttaggcagtataaagaataggacttgtttttgtttttgttttgttgcactgaagtttgataaatagtgttattgagagagatgtgtaatttttctgtatagacaggagaagaaagaactatcttcatctgagagaggctaaaatgttttcagctaggaacaaatcttcctggtcgaaagttagtaggatatgcctgctctttggcctgatgaccaattttaacttagagctttttttttttaattttgtctgccccaagttttgtgaaatttttcatattttaatttcaagcttattttggagagataggaaggtcatttccatgtatgcataataatcctgcaaagtacaggtactttgtctaagaaacattggaagcaggttaaatgttttgtaaactttgaaatatatggtctaatgtttaagcagaattggaaaagactaagatcggttaacaaataacaacttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagagccgtaaaaactgaagttctgcctctgatgtattttgtgagtttgtttctttgaattttcattttacagttacttttccttgcatacaaacaagcatataaaatggcaacaaactgcacatgatttcacaaatattaaaaagtcttttaaaaatactgtagataattaaccaaggtagaatgaccttgtaatgtaactgctcttgggcaatattctctgtacatattagcgacaacagattggattttatgttgacatttgtttggttatagtgcaatatattttgtatgcaagcagtttcaataaagtttgatcttcctctgcta

SEQ ID NO: 310159 - DNA, 1822 bp, Homo sapiens
cgctagcagggctgaagagaagatggaggagctggtggtggaagtgcggggctccaatggcgctttctacaaggcatttgtaaaggatgttcatgaagattcaataacagttgcatttgaaaacaactggcagcctgataggcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagcatgtgatgcaacttacaatgaaattgtcacaattgaacgtctaagatctgttaatcccaacaaacctgccacaaaagatactttccataagatcaagctggatgtgccagaagacttacggcaaatgtgtgccaaagaggcggcacataaggattttaaaaaggcagttggtgccttttctgtaacttatgatccagaaaattatcagcttgtcattttgtccatcaatgaagtcacctcaaagcgagcacatatgctgattgacatgcactttcggagtctgcgcactaagttgtctctgataatgagaaatgaagaagctagtaagcagctggagagttcaaggcagcttgcctcgagatttcatgaacagtttatcgtaagagaagatctgatgggtctagctattggtactcatggtgctaatattcagcaagctagaaaagtacctggggtcactgctattgatctagatgaagatacctgcacatttcatatttatggagaggatcaggatgcagtgaaaaaagctagaagctttctcgaatttgctgaagatgtaatacaagttccaaggaacttagtaggcaaagtaataggaaaaaatggaaagctgattcaggagattgtggacaagtcaggagttgtgagggtgaggattgaggctgaaaatgagaaaaatgttccacaagaagaggaaattatgccaccaaattcccttccttccaataattcaagggttggacctaatgccccagaagaaaaaaaacatttagatataaaggaaaacagcacccatttttctcaacctaacagtacaaaagtccagaggggtatggtaccatttgtttttgtgggaacaaaggacagcatcgctaatgccactgttcttttggattatcacctgaactatttaaaggaagtagaccagttgcgtttggagagattacaaattgatgagcagttgcgacagattggagctagttctagaccaccaccaaatcgtacagataaggaaaaaagctatgtgactgatgatggtcaaggaatgggtcgaggtagtagaccttacagaaatagggggcacggcagacgcggtcctggatatacttcaggaactaattctgaagcatcaaatgcttctgaaacagaatctgaccacagagacgaactcagtgattggtcattagctccaacagaggaagagagggagagcttcctgcgcagaggagacggacggcggcgtggagggggaggaagaggacaaggaggaagaggacgtggaggaggcttcaaaggaaacgacgatcactcccgaacagataatcgtccacgtaatccaagagaggctaaaggaagaacaacagatggatcccttcagaagaagacatgataggattgtgagtttttctctaactttggatgcagtgagatgaccagtgtgttccagttaaagaagaagagtgttttaaaatcataaaccaaataaagaatcctaccttacatt

SEQ ID NO: 310160 - DNA, 2126 bp, Homo sapiens
  misc_feature (22)..(22): n is a, c, g, or t
  misc_feature (75)..(75): n is a, c, g, or t
  misc_feature (714)..(714): n is a, c, g, or t
  misc_feature (1467)..(1467): n is a, c, g, or t
  misc_feature (2119)..(2120): n is a, c, g, or t
  misc_feature (2123)..(2123): n is a, c, g, or t
  misc_feature (2125)..(2126): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggantaggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtgcccgacgcacattccagttaggcttcatgtactactctggctctggaatatggaaggattataaacttgccttcaaatatttttacctggcatctcagagtgggcagcccctngccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaannaanann

SEQ ID NO: 310161 - DNA, 1143 bp, Homo sapiens
  misc_feature (22)..(22): n is a, c, g, or t
  misc_feature (75)..(75): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgtgagttttgaaggaaaatgaaaccttaaatagctccatcctgaaataactatagacagcatgtgaaaggagttgagcaatagtattccagctctgctgcatgaacccagtctagggaggttaccataatgcactgaaacagtggtgtcagggcaggagtacagcagaagcctccgaacccccaacagctaaattttatataaaatgtattcacctatatgaagaaatatgaaactgtctattatcttagggtgacatgtttgcatgatttttacttttcaaatattttataagctaaatgtaattcctttctatttaataaatgccgatcgcaag

SEQ ID NO: 310162 - DNA, 420 bp, Homo sapiens
  misc_feature (22)..(22): n is a, c, g, or t
  misc_feature (75)..(75): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatt

SEQ ID NO: 310163 - DNA, 656 bp, Homo sapiens
  misc_feature (22)..(22): n is a, c, g, or t
  misc_feature (75)..(75): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcattggtgagaagaaaagaacaggagaagaactatgaaaacagcagatgtgaggagcaagaaagatggtgattggctgcgctaaactgaaaagttagtgaaacttcaaagttgggggattccaactgatatttttaaatcagcaatgtctaaggtgaccattaaaaattgtttttgttcctaggataactcatcttctcttctgctctatgaaatcttagataaaatgtgtattcctcat

SEQ ID NO: 310164 - DNA, 600 bp, Homo sapiens
  misc_feature (22)..(22): n is a, c, g, or t
  misc_feature (75)..(75): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcattggtgagaagaaaagaacaggagaagaactatgaaaacagcagatgtgaggagcaagaaagatggtgattggctgcgctaaactgaaaagttagtgaaacttcaaagttgggggattccaactgatatttttaaatcagcaatgtctaaggtgaccattaaaaattgtttttgttcctagg

SEQ ID NO: 310165 - DNA, 750 bp, Homo sapiens
  misc_feature (22)..(22): n is a, c, g, or t
  misc_feature (75)..(75): n is a, c, g, or t
ggtggaccgcgcttaccgctgncctcttggaagacttgagggcgtggcctgtagagccaggtgcgccaagtgacnggcgagctagcggaaagccgcctcagggacttggaggatgtagaagtgggaggagaccgagggtcaacacgaattgtccgtgctcactccaactgccctgttgaggaggattttcaccagctatcaaagcagaggaacataataaaagacaaaaggaaagaaatgtcaccacacaggtatcagcgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcattaagcctggtgtcagctgatgccaagtcttcaaggatggaaagacattgccctacagaactagggagaggaacgttgacattttgtttttgaaagggtgagaagaaaagaacaggagaagaactatgaaaacagcagatgtgaggagcaagaaagatggtgattggctgcgctaaactgaaaagttagtgaaacttcaaagttgggggattccaactgatatttttaaatcagcaatgtctaaggtgaccattaaaaattgtttttgttcctaggataactcatcttctcttctgctctatgaaatcttagataaaatgtgtattcctcat

SEQ ID NO: 310166 - DNA, 872 bp, Homo sapiens
  misc_feature (47)..(47): n is a, c, g, or t
  misc_feature (55)..(55): n is a, c, g, or t
  misc_feature (61)..(61): n is a, c, g, or t
  misc_feature (98)..(98): n is a, c, g, or t
gtttttttgcaaaaagccttacacatttaaatgtaaccaatcagtgnttttaccnacaatntgaacttaagtcgaggcttctttaattaacccccgcncaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310167 - DNA, 908 bp, Homo sapiens
  misc_feature (47)..(47): n is a, c, g, or t
  misc_feature (55)..(55): n is a, c, g, or t
  misc_feature (61)..(61): n is a, c, g, or t
  misc_feature (98)..(98): n is a, c, g, or t
gtttttttgcaaaaagccttacacatttaaatgtaaccaatcagtgnttttaccnacaatntgaacttaagtcgaggcttctttaattaacccccgcncaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcataaaaaaaaaatggatggttggctggctaagagcga

SEQ ID NO: 310168 - DNA, 2445 bp, Homo sapiens
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310169 - DNA, 880 bp, Homo sapiens
tcatggctccaataatacgactcccaaagggcatcaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcacatctttttacctatcaactggctggtgatctgatattttcagctcccaccggaccccccacgacaagacat

SEQ ID NO: 310170 - DNA, 997 bp, Homo sapiens
  misc_feature (997)..(997): n is a, c, g, or t
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaatagaaaaaacacccactagacctttctggcctctcgcggggcaccctttcaggcgtttatctctagtcgcgggcagattatggacctcgttgcgctgaccctaacgaccttcctcaaagctgagcacgacgctccaccccgcctagtccaccccaccaaccccttattgctattccgccaccccacaccaccctcccttaccacacccagcagaataccgactttacactgcccgacactcgtgcccccgctcn

SEQ ID NO: 310171 - DNA, 631 bp, Homo sapiens
tcatggctccaataatacgactcccaaagggcatcaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310172 - DNA, 1017 bp, Homo sapiens
  misc_feature (31)..(32): n is a, c, g, or t
  misc_feature (41)..(41): n is a, c, g, or t
  misc_feature (53)..(53): n is a, c, g, or t
  misc_feature (72)..(72): n is a, c, g, or t
  misc_feature (92)..(92): n is a, c, g, or t
  misc_feature (100)..(100): n is a, c, g, or t
ctgtaaaatcagggtgcatccacgattttgnncaaaggccntccaagttaatnttaacccagtagggctttnacacaagtttggaactaagntccaatantttcttattacccccggtacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310173 - DNA, 1027 bp, Homo sapiens
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaagccccaaccaaattcggcccctcgccaccccactccccacacttccgttcttattaacacgacctgacggcactccgaccgtcacccccgccacctccccccctcccatcccccgcccctcctgactcggggggagtctttaggccttcctacacggggtaatcaaagccccgcctgcccagccccggctgccctccggacacgcccaccccgccccggcgctcctcccc

SEQ ID NO: 310174 - DNA, 1103 bp, Homo sapiens
cgttgttagcatacacgcaaccctcaatcttcaccatgaatatccgtggaccatgattttgcaagagccccccaaacttttagtcaacatgtttccacccttatagaccgagttatgtcacagtcaggcatacgtccggagcaacaagccatggtcaggtaatcgactccctataggcgccaggaatccaatgatatagacataccaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310175 - DNA, 939 bp, Homo sapiens
  misc_feature (802)..(802): n is a, c, g, or t
  misc_feature (822)..(822): n is a, c, g, or t
  misc_feature (826)..(826): n is a, c, g, or t
  misc_feature (831)..(833): n is a, c, g, or t
  misc_feature (836)..(836): n is a, c, g, or t
  misc_feature (840)..(840): n is a, c, g, or t
  misc_feature (842)..(842): n is a, c, g, or t
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaaaaaaaataatggcccttaacaaaaaaaaaaatggcctcgttggcctcaacggtgganctctgcgccgcttccctaangagngtatnnngancctncncagtgactggctacgctccgccgtccgcctctggagatcggttgatctctgctcacggcggcgctcgtgagccccggtgtgggacggccgacagcgg

SEQ ID NO: 310176 - DNA, 809 bp, Homo sapiens
  misc_feature (15)..(15): n is a, c, g, or t
  misc_feature (21)..(21): n is a, c, g, or t
  misc_feature (24)..(24): n is a, c, g, or t
gtcatgagcaacgangctctnaanctccacgggtacacgaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310177 - DNA, 884 bp, Homo sapiens
ttatcagcatgctgatcaccgcaccagtgaacagacacgccacagccgcttggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactacagcgtgcgcgcgtttctatttaaagcatcaacccttcatccaactcttgtcctcttaagcaggcccccatccgatgaactctcctacatacccactaccttctctcttttccatcgcacaagaatcatcacgcacgataaatcccatactcaccactagtaaacgccatcccgcccagaatcattaaaacttctacccttatcccgcaccctcctttccccccccaccaaactgctgtacttcctcctataatcccacaacacacacgccttttacaatccactcctatttctgcccaccaacttcttcctccccctcttataacgatatagagaacctaccagtcttaaatacgctccctctcctccacaaccctctaataacacacctcccgacaatctatttctctcccaacactcacttcatcgtcgcctaccgccgtgtatcgcctacgcacccgtctcttcggatatttttcatttttccatatgtaccccccccacctacaccatatgaccctcgttttattccccatcacgcccgctctctcctgaattttatatattat

SEQ ID NO: 310178 - DNA, 944 bp, Homo sapiens
  misc_feature (42)..(42): n is a, c, g, or t
accttcctactcccccgattcgcattacttaaaaacttcccncgcctcagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310179 - DNA, 878 bp, Homo sapiens
ctacggcagcgcatcaccaagacgcgccacacccagaacatgtcctagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatcaaacatgtcgacttacaccgcccactctatatgtactccattcctcacgctccccataaaacttttgactgattcaagcaatttcttatcgtatacatacagttcgattcccagaaaagaacaccatgcattatttgcggcacgaagctcttccgcccctctgtttcatcatatcctatctcactaaattgagcatcgcgcgtctgacacgtttatcaccacacagccttattttctatgtatccgaaattatataccccccaatccttttcagtattgcatcagctatatatccgccgttacacgacacaagaaatcctcagtcctctaaccttaacccccccgcac

SEQ ID NO: 310180 - DNA, 970 bp, Homo sapiens
aacatttccgtatgtattttccccaattgcttcaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcatgcacttgaaattttaatagcacgaatcacaaaaaaaaaatggcctcgttggcctcaacggggaccttaggccgttccttaagaggttattcagagcccggtactacttatgccttggtgtagttaagcaacgctcacccattaagcggtcacgtattaaaaag

SEQ ID NO: 310181 - DNA, 635 bp, Homo sapiens
  misc_feature (27)..(29): n is a, c, g, or t
ggggcccggcccgccccggcccttggnnnggggttttccgagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310182 - DNA, 987 bp, Homo sapiens
  misc_feature (1)..(1): n is a, c, g, or t
nttttacaccagctagtgtttttccaccaaattttgaattataactcaggtcattttttaattaccccccctcgcgggattccaattaggctgaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310183 - DNA, 1043 bp, Homo sapiens
  misc_feature (1)..(1): n is a, c, g, or t
ngcaatatatccgcagagcccgaggctctccgggtccagaatttattagcatatacccagccacccggagaggcccaaggcaaaagtgtgtccttgcactttaacccggttccatcccatgttatttatttgtcccgggaaggctaaagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310184 - DNA, 1008 bp, Homo sapiens
ccaatagggctttcaaagttaatttccaagcaagtgatgctttgcccaaccagtttggacataagttaaatactttttttattaacacccgcgcagggatcccaataaaattagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310185 - DNA, 919 bp, Homo sapiens
  misc_feature (44)..(45): n is a, c, g, or t
  misc_feature (48)..(48): n is a, c, g, or t
  misc_feature (57)..(58): n is a, c, g, or t
  misc_feature (74)..(74): n is a, c, g, or t
  misc_feature (849)..(849): n is a, c, g, or t
gaggggtgaagcacaaaagggaaaggaccagccacggttttggnnggntgttcgggnnaaccatgaatcatcanagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcactnccctcaagaataataaaaaataaaaaatgggcttgtctgagcctatcgtgggagttttgcgcacagtatc

SEQ ID NO: 310186 - DNA, 822 bp, Homo sapiens
  misc_feature (822)..(822): n is a, c, g, or t
ccaaatataataactcattccaaaaccccccgcttagatcacagcaatactgaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagcccccacaatgtccctacgacaatagagattacctatatatttaacttattcttcgacttactactataaaaaccaaatggctataacatgtcaaattcaacttccacaatttaaagccctacagtaaaatatgtgcatactaaaacaagggcccatatcaatctcgtttccccccttaacgattcaatttcctctatcaccaactacccctcgctttacttttaacatcccgctctttgttcaccactctaaaataggtacttgccttaatgcgaccaatattgtaacactctcatcatataaccacgaactattgtccctctccaacaacgcaaccaaaaatatattaaaaatctcaatatcacataatcgcctcacaan

SEQ ID NO: 310187 - DNA, 672 bp, Homo sapiens
aacaagaacaatagaaagacacaaagacaaaaaaagaaaaccagaacgtttgaataacaatgaaaactaaaattttaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310188 - DNA, 950 bp, Homo sapiens
tcctatcggagcgtacacaaagacgcggcaacagaacacaaaggggctgggaggcacagaggatcaaacttcaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacagctgcccccgaaatcccgttgaaataaccgtgggatcggaccagccgctcttatcaaccgtactcttaaccggcctgttctggaaaaacaaattcatccacactcctcttattgatcataagcgccccacggccccacgatcattcacagagcctttaataacttccaccgccccttacacccgcagctaaaccccttgccggtgaaagcgcagtccctactcatgccccttctcatcaacacactcgatccaatacccaacaacggcccgtaatgcctaggcgattcacaaactgcaaaccaccccttgcacttccctaaaaaagccagctgatatagttcgggctcagtataaggcaacaatggaggacgcatcgtgaaccggtgtgtggcccggtagcagttgaactctcacccgctttacccttcctccacaccatattggtcgctgccaaatcgtttagcagcgtggcggctccgccacgcacaacataaccacgccagaactcgatcccgcagcgatataggaaaacagccacaaatagccgctcgctcctgcgatacatacgacaaaccaccataatgccctccgagcgccgcgtatctagagtaggacaggacgcccgcgtaaccgcaccgctacactataatatacactcctcatattataccctctcgccccccccactgcaacgaaaagttcaacgtat

SEQ ID NO: 310189 - DNA, 675 bp, Homo sapiens
  misc_feature (40)..(41): n is a, c, g, or t
  misc_feature (44)..(44): n is a, c, g, or t
agcgggcgggaccgccggggctgccccgcaccggtttggnnggngtttcgagcctaccaagcgataacataaataagccaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310190 - DNA, 894 bp, Homo sapiens
  misc_feature (40)..(41): n is a, c, g, or t
  misc_feature (44)..(44): n is a, c, g, or t
agcgggcgggaccgccggggctgccccgcaccggtttggnnggngtttcgagcctaccaagcgataacataaataagccaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaagcagaacataaatcaccacccgccaagacatgtacactaataaatcgcgataccgcctcatgctagccgcgccggccgccctcccacctacactgctttcgcctgtccttctatttcgtccctctatctactccatcccattctaactcaccccccttatctcaccatcgctgtacccgccgcactgtccagaggcgcgacgattatagtaatcattat

SEQ ID NO: 310191 - DNA, 802 bp, Homo sapiens
cgttgttagcatacacgcaaccctcaatcttcaccatgaatatccgtggaccatgattttgcaagagccccccaaacttttagtcaacatgtttccacccttatagaccgagttatgtcacagtcaggcatacgtccggagcaacaagccatggtcaggtaatcgactccctataggcgccaggaatccaatgatatagacataccaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310192 - DNA, 882 bp, Homo sapiens
ttccgggattaggattcaatagattaagcaatgcccaactggccgtgtcaaaagtctgacaaaatattaaccttaaaccaagtcgcaagaatatcgcgaaataaggggtcaccaagtcaatttgggcatcctttctccaaaagcttggaaatgagaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310193 - DNA, 905 bp, Homo sapiens
  misc_feature (1)..(1): n is a, c, g, or t
naaaaaaataacaaaatttccctttttttcataagcccggaaccaatacaaatccaacccttgaatacaaatgtccccaaaaaataaacacgaaaaccccggtgtcccccaaggtagaatttgggacattcattttttcccaaaagtttgggaaaatcccggaaatatttaataaccgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310194 - DNA, 1070 bp, Homo sapiens
gttagataccaagctaacctaaatttttcacccttggatacccgggaacccagtttttgccagagcctctcagacgtttagtcacatggattccacatatagaccgatttaatgttccagtaaggagagtccgggacaccaacccaaggttgagtatcgcctcatataggcgcaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310195 - DNA, 945 bp, Homo sapiens
  misc_feature (1)..(1): n is a, c, g, or t
ntccagccccagttttaggccttggaatatgcggtgtatccagtattttgccaaagcgctctccaaatttttgtccaatttgattccccactaaggacccattttatgtaacagtaacgcatcattccgaggcagaaagaccatggttgagtaaacgactcccttaaggggccggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310196 - DNA, 851 bp, Homo sapiens
actccccagatcaaggtatatggatacaacatcctgacctttaggtgccaggtactcttgtaatttaccacgcggtacaagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310197 - DNA, 1086 bp, Homo sapiens
cctcctgttttctagctgacccgacacacccaatctctcgtgcacgagaaataccgcgatccccgttcttgccaaagcccctcaggattttgttccctcttcttctccccctatcggcccattaatgtcacacctatcgatattcccggacagacaagccaggctccgtaacacatccctataggcgcaaagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310198 - DNA, 1017 bp, Homo sapiens
aataattcaaagaatttttggccctaaagccaattccagtaagattgcaaacgaagtaagggtttgaacacaacaatttagaaaaaaaagtgcagtgactttcttaatacactcccgcaacagaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310199 - DNA, 979 bp, Homo sapiens
  misc_feature (64)..(64): n is a, c, g, or t
caagtgtggatttgtacacaacagtttccaactaagtaacagaggcttcataattatcccacgntctagtaaataagatgaatcgaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310200 - DNA, 1124 bp, Homo sapiens
  misc_feature (1)..(1): n is a, c, g, or t
  misc_feature (81)..(81): n is a, c, g, or t
  misc_feature (83)..(83): n is a, c, g, or t
ntcttttacattacacctcataattatcataatcgccgtcgtagatacacagatctctgagtcacttcattgagccacgantntgtaatcataccggggcgcgcacttctaatgtcctacgatttcttcccatacacacacaccactcagaaggcgcggcagcaaaaaggtgtccttcaatatatcccgcatctatcaaatctaataatattgtcggcaaggtctaaaaattctaaatatattatagcaaattagcccaagcgcgccgtcttctaaatgggttggcacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310201 - DNA, 977 bp, Homo sapiens
  misc_feature (79)..(79): n is a, c, g, or t
caccccacacgccccaccaacaaaggttctctcattatatcccctctcccattctattaatttccctgggacctaaaanattcccaacgatctaccaccatagccaaaaatggctcttttcttaaaagcacttgaccaacaatatctacccttatatcaaaggctaccaagaataaatctgcaacatccgtgctctaacaaagtcgaattttggaatatcattttctccaaaaatccttggtaactacagaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310202 - DNA, 467 bp, Homo sapiens
cttccattttattttttgcaattctacgatcttcctcccagaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310203 - DNA, 874 bp, Homo sapiens
ttctccgctgtcttttatttcttttatatcttgtctccccctggcataattgtgaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaattccccccccccccacaaaattatcaatttataactctccccacaaccactccaccattatttattgtcccccccatttcaccacctcattatttttaactctccgctgtcataacaccttcctcccactacttctttctataactttcacacgacagctctatacttcaatccacaccccaacagatcatcatcctcttattccaaaccttatttaattatctacctcctctttatattgtctagtactaatactctacttacacctcttcgaccccgcgtactttcctcacccatttacaagtgatcgttggcacccacccatgcccctatctctcgcttctatgtgcgcaccactacctccgaatcccactacctggacgataatctc

SEQ ID NO: 310204 - DNA, 867 bp, Homo sapiens
  misc_feature (867)..(867): n is a, c, g, or t
ccccccctcccacatcataatccctaccccccccttcgtatttgtgaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcagatcaactgaatggccacacgcacattccaataaccccccaaaaaaacagcaaaaaatgggcgtcattggccacacaggtggagccctgaggtcctttccttttgggggggtaaattcgaatttctgcgtccttaaccatcgcacccgctctgtcgaatgctgacaccgccccgctccacgaaaggggacatctgtattacacacttcagtctan

SEQ ID NO: 310205 - DNA, 973 bp, Homo sapiens
  misc_feature (203)..(204): n is a, c, g, or t
  misc_feature (209)..(209): n is a, c, g, or t
  misc_feature (234)..(234): n is a, c, g, or t
  misc_feature (236)..(236): n is a, c, g, or t
  misc_feature (238)..(238): n is a, c, g, or t
  misc_feature (244)..(244): n is a, c, g, or t
caaaccccccacccggaagcccgggggaaaaagggttccccaccttaaccccccccaccagttcttttattttcccgggaacgtaaaaatccaaatgaacttcaaccaaaagcccacctgcctttttttaaacccttaacaaaaatattcacccttaaaacagaatccccaaaataaagccgaaatacggggcccacaaatgnngattntggcaatcattttttccaaaagttntngnaaatcncgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310206 - DNA, 1005 bp, Homo sapiens
ccttcctacatctcaccccttgcaaggccccacccacaagtgtttctcccacttatccgcgcgcaccagcttttcattgtcccggcagcccaaacatccacaatcacctcacccgaaaacaccaacctcccttttttccaaacgcctttaccacaattatctacctttcagcccagagtccctgagataaacccgcacctaggcgctccacaattctggtttttgcctcctttttttccaaaagtcttggcaatccacccaatatctatcaaaccaagaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310207 - DNA, 926 bp, Homo sapiens
tattatatatcaataatgtgtaaatatataatacatataaaggctcggggaatgttacacaagttcatcactaaatctttaacacattatgagcaaaataataattgcaattcattagaaggataatataataatagatatgtataaaaaagaggatagataaataaacacctcattacgttagaatcaaattacaataagcacacactttctccaaatatcttgtacatgacagtaaatattatccacaagcattgtatgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcacatgcgtgccggttatttatattataccttaagttccatgactgttgtagtacaccgctgca

SEQ ID NO: 310208 - DNA, 949 bp, Homo sapiens
cacataaacagagtcacggaacatactatgccagtacagcgttatagcgcaaaagtatgacaccagtatctcaattaatacattaccacagccaacactctcagctctcataacatataactcacaccgttaccgtacaaacagagtgatacgtgcaaatgacgtatctacgtcaccaccaacacctattaagacaatcattggtcacgcaaagtctcgcaagtaccagagcgacttgatgaaccaatatggtatgtgaacccagtattcccatctctggccaatcgacactgacgggctgcacaatcccattccccgcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310209 - DNA, 996 bp, Homo sapiens
tttcgtctacaataaccaatccgaaacagtaaatgatatgttaataacaagtatatagttaataaccaaataactctttaatattaccccacttcacaggaaattcaaataagaaattgcatctatatcccgagagtggcttgtttttaaaatctactcgccaaacatcatctccctttcattcagagtctccataataaatccggaattatgtgtttaacaatgtcaattctgacattcatttttcctaaaagttttggtaattacagaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310210 - DNA, 963 bp, Homo sapiens
  misc_feature (193)..(194): n is a, c, g, or t
  misc_feature (199)..(199): n is a, c, g, or t
  misc_feature (224)..(224): n is a, c, g, or t
  misc_feature (226)..(226): n is a, c, g, or t
  misc_feature (228)..(228): n is a, c, g, or t
  misc_feature (234)..(234): n is a, c, g, or t
aaggggcgatgcactttatcaccgtcacaaagatatattaatgtgtgccggaagtataaggactcagaatgaagtctcagcacaaattgcacaacatgccctgttgtcgaaagcctcgaccaaaaaaaatcacaccttgaggcccaaagtcaaccaagaaatgcgcgcggaaataacagtgctcaccaaatgnngattntggcaatcattttttccaaaagttntngnaaatcncgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310211 - DNA, 1079 bp, Homo sapiens
  misc_feature (159)..(159): n is a, c, g, or t
  misc_feature (288)..(288): n is a, c, g, or t
  misc_feature (311)..(311): n is a, c, g, or t
cattcgtttagccatgccagccaacccctagagtctcaaccctggaatcaccggtgttcacagtttttgcgcaaacgctccccaaccgtttcagaccaattcgatcccccactatcgcccgatgtattgtcccagtctagcatagtccccggacaacangaccatggctgagtaatcgcctccataggcggccagaatccaattggcttcagccataggcaccactgcctgtttttaaagcctgtaccaaaaaatctaccctgaatccagagtcaccagaataatgangaaaataggtgctcaccaatgtngaatctggccatcatttttcccaaaagtcctggaaatgccgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310212 - DNA, 760 bp, Homo sapiens
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttatggattcataaatgtataatcttttactatattcacgagttattcttttttacctttgtcttcttagagtctagatggtcagaatattatatggcatcaacataataatttcatttctgaggtagggtctttcttccaaatagctgcttt

SEQ ID NO: 310213 - DNA, 743 bp, Homo sapiens
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310214 - DNA, 935 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310215 - DNA, 983 bp, Homo sapiens
  misc_feature (1)..(1): n is a, c, g, or t
  misc_feature (846)..(846): n is a, c, g, or t
  misc_feature (866)..(866): n is a, c, g, or t
  misc_feature (870)..(870): n is a, c, g, or t
  misc_feature (875)..(877): n is a, c, g, or t
  misc_feature (880)..(880): n is a, c, g, or t
  misc_feature (884)..(884): n is a, c, g, or t
  misc_feature (886)..(886): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaaaaaaaaaatggcctcgttggcctcaacggtgganctctgcgccgcttccctaangagngtatnnngancctncncagtgactggctacgctccgccgtccgcctctggagatcggttgatctctgctcacggcggcgctcgtgagccccggtgtgggacggccgacagcgg

SEQ ID NO: 310216 - DNA, 912 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcactccgccattcccaattagccccttacaccaacaaaaataacaactggccccgcgccccagggcagacctctgaggcgcttctttaacgagggaaattaag

SEQ ID NO: 310217 - DNA, 884 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcacatcaccaatcgctggtcctctcgatattttaacatctccgccgaaaaatgaaatgaacagcgggccccgtgg

SEQ ID NO: 310218 - DNA, 1159 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcagaaacgatggcgatcgcgatttgagattttacacgaaacacatgggcttcgtgggcttacccgggggactcttgcagggcggttcctttgaagaggggtaatgtatgatcatccgtaatcgactccctacctcgccgttgggagcggcgacgctataatgcaattataagcggccccccgtcgtccccaatcagcggcagccgcgaaatacacggggcgacgggcgtgatggtctgcactcggaaccgacgataatggcctcgtccgtacggacgcccagtcgagaccacaaccggcctacgctcaggaggaacctgatgtgtttgctcgaccagcactccacgtcgg

SEQ ID NO: 310219 - DNA, 884 bp, Homo sapiens
  misc_feature (1)..(1): n is a, c, g, or t
  misc_feature (814)..(814): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcactnccctcaagaataataaaaaataaaaaatgggcttgtctgagcctatcgtgggagttttgcgcacagtatc

SEQ ID NO: 310220 - DNA, 634 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaa

SEQ ID NO: 310221 - DNA, 1062 bp, Homo sapiens
  misc_feature (1)..(1): n is a, c, g, or t
  misc_feature (925)..(925): n is a, c, g, or t
  misc_feature (945)..(945): n is a, c, g, or t
  misc_feature (949)..(949): n is a, c, g, or t
  misc_feature (954)..(956): n is a, c, g, or t
  misc_feature (959)..(959): n is a, c, g, or t
  misc_feature (963)..(963): n is a, c, g, or t
  misc_feature (965)..(965): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggctgaggagtaggaggaggggaaaaggagctgttggtctcgctgtctctggattgacagaggtggaagaaaatccacatgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaaaaaaaaaatggcctcgttggcctcaacggtgganctctgcgccgcttccctaangagngtatnnngancctncncagtgactggctacgctccgccgtccgcctctggagatcggttgatctctgctcacggcggcgctcgtgagccccggtgtgggacggccgacagcgg

SEQ ID NO: 310222 - DNA, 787 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagaacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 310223 - DNA, 830 bp, Homo sapiens
  misc_feature (1)..(1): n is a, c, g, or t
  misc_feature (693)..(693): n is a, c, g, or t
  misc_feature (713)..(713): n is a, c, g, or t
  misc_feature (717)..(717): n is a, c, g, or t
  misc_feature (722)..(724): n is a, c, g, or t
  misc_feature (727)..(727): n is a, c, g, or t
  misc_feature (731)..(731): n is a, c, g, or t
  misc_feature (733)..(733): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaaaaaaaataatggcccttaacaaaaaaaaaaatggcctcgttggcctcaacggtgganctctgcgccgcttccctaangagngtatnnngancctncncagtgactggctacgctccgccgtccgcctctggagatcggttgatctctgctcacggcggcgctcgtgagccccggtgtgggacggccgacagcgg

SEQ ID NO: 310224 - DNA, 919 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaactccaatcaagttttttgccccccataaataaagacatattggactatattagttttaagcggcgggtgctctccagaccgcttccttctcatgagggcttactacccgctactttagcccctgactcacatgcgtttgttactctcgtgttccccaaaccgcgaccaacgccctcactaggcgactatactgttctcaccgagtagcgagacgccccactactcacttcttatttcacggtttaacacgctcccccccccgatagccgtttttttctttcatct

SEQ ID NO: 310225 - DNA, 873 bp, Homo sapiens
  misc_feature (1)..(1): n is a, c, g, or t
  misc_feature (825)..(825): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaatctgtttaacgcactcggcatccccattacaaccggacaaaggtctcttgtttaatataagtaatgcttgccgccctgatccccctccacgaccaactcactttccctctacgccaatatcgcctggcgccccagaagtatatagtcctcaccaatcgccctaaaccccccgccgccctgtcgtattgacngtcgaactataccccctcccccccctcgatgctttttctctgtctatc

SEQ ID NO: 310226 - DNA, 857 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaactagaatcagttttttgcgtaataagtatgatgggtctgcttttacgcgcgggattaccattatacatgtactaagggttctttataattgattattattggtcactgacacctagggttctgtcaatttacgctaataaaatcagattcaatgtagtttggaatggaaggaggtgcatgagatgtctatctttaaacggcatatttcatcctatatctgtac

SEQ ID NO: 310227 - DNA, 815 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaagtcttaataccttgtatttacgtatcattcctccacggtcttcttgttacacgaatcgatgttgaaccatagggcacctattagtcgagtgtttggatgctcatgcaggacagatggggttagaatcgaaatataagatatcctctgtgaaccgatcattacaaaggcaaaattcatctc

SEQ ID NO: 310228 - DNA, 795 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaccgccgaagcacttgtaccccattaccactcccaaataggatttttttaaataacaacacgtggagcactgtgcacttattttcaaactctgcgtcctagttaatatatcattgatagttatttaaaatcacaatcacaaattcgatactttcttcacgat

SEQ ID NO: 310229 - DNA, 806 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaataaaataattggccttatggtttcagaaggggatctctgcgcaccatacgttgtatgaggggtacttattatcccttggtcactgctctcagtcctcagaccaacgttttcagagacgagtataaatattaatatggagtcaatggtgttccccgcacccgtgagacgacg

SEQ ID NO: 310230 - DNA, 711 bp, Homo sapiens
  misc_feature (1)..(1): n is a, c, g, or t
  misc_feature (676)..(676): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaaatttaagcgtttgctttaggccggttttttttacactctnaaagtatttttaaagataaaatgaaacctgcacct

SEQ ID NO: 310231 - DNA, 972 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaggggggagtggcaattaccagtaagacaaaggagtgtttcttacttgaactaagcaacgccaccctgccaccgatagcgcacccgactacgccgcctgcgcccccaccagccggccgcccccccccccattttcctcgtctgtccaccgcccccatcgcccgaatcgcatgccccatccgaccaacctgcagcccgcccctcttccgaccaggcggcgtcctcccccgccggagaccatgcgcccggacgcacccggcacaggagacacgcgacgcccggacgcaatcccccatcacgcaccctcggactcgcacgcagcggcggctcgatggcccg

SEQ ID NO: 310232 - DNA, 524 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactattctggacatcattttttccaaaagtcttggaaatgacaggaaatattgatgaagcagaatgggagtggaaagcaggaattacatgatggactggaaaaatcaatttaacgattacactagcaagaaagaaagttgtgtgggtctctaattaatagattttttcctttagatcaaggcaaaaatatcaggagcttttttacacacctactaaaaaagttattatgtagctttaacttagtattttacctagcatttcaaaacccaaatggctagaacatgtttaattaaatttcacaatataaagttctacagttaattaatggcctggttcaatttctttctttccttaataaatttaagttttttccccccaa

SEQ ID NO: 310233 - DNA, 826 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaatttggtgtatgtaaaggatggtgtgtgcttactgtgtttatttacttctatttttatcgcctttgtcattttagatattaatcttttctgtttataggctcgtgtactgtcttaaggtcctctgtgtgaagtgtcgttgtttatagttcttgaatatttaccaccttctactaactgacgtccactccgcatcatcctcatcttttgaccttaattcatcgacgattgctagttccctatatacaactatcattgcataccttcca

SEQ ID NO: 310234 - DNA, 959 bp, Homo sapiens
  misc_feature (1)..(1): n is a, c, g, or t
  misc_feature (636)..(636): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattaaaaaaaataaaaccaaaaagaaccaaaaaaaatgtacagatagaacaggaccagagcggcgacacaaactaanataaggcccttttgggcccaaaagggggaggtctttgggcgcgtttcctttaaggggggggatatcatgatcctggttcctgatgtcaggcgcaggggaaagtcgctggggagaaggtttctgtcccattaaaggtgggaatcccggtttccccaaaatttggggatactcgcgagaaaaactcgctaccttaggccctttaggcgcgagtccacataaagggccgcgtgggggggttagaccgtgaggagccggcccgtggaagattcagcaagtggaactgctcaaccaggtggagcatagaccgtgggaattagaagttg

SEQ ID NO: 310235 - DNA, 634 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattttatgtagtttgaactttgcaaacgcggcctgagtcatatcttctttactaaaaatcttacacggtcccccg

SEQ ID NO: 310236 - DNA, 865 bp, Homo sapiens
  misc_feature (1)..(1): n is a, c, g, or t
  misc_feature (865)..(865): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgatacagactctaaagcccccacggtaactgtgggcctatttaacactggcttgggcactcttttctctccttatcaacacaccgaattccacccgaaaaaacaccccacgcccccgttcccctcaccagcgagcactcgctctttttccttttaggagggcgtcctcttacctccttactggatactgccgttgaccgccgcacctgctattagccctctatgctcctatcctcattcccgcccctgccgtactatgtatcgcagcgaaccttattgcccccggcggcctacacaggcactattccccttatagtgctgtgaatggccccgccgcccgcacn

SEQ ID NO: 310237 - DNA, 911 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagcctcaccccccgcctcacccagctttcaccgccccgacccacacctccgcgcctggacacccctagtggtatcccccccgcgacgcgcgcgccccgacctagccaatgcccacccagcgccccgtcaatccgcccctcaaagccccgtacctcctagttatcatcagtcctgcctcgcccgcaccctataagaacgaccctactcgacgaacaggtcccctcccacccgcccaaactacctgtctctacgccgcaccgctctacacaccctaacccgacacctcgactggagatggcacaccgccccgccacaacaataaacacctcgtacgcctccagctcccccccagccccaacataggacgcaaaactcgctatagaccaccccccccccgtccactcataccacgacacgcctaatgagcccggcggccgcccacgcacggtaccaccagtcgcaccacgcatcagcgaccgccaag

SEQ ID NO: 310238 - DNA, 914 bp, Homo sapiens
  misc_feature (1)..(1): n is a, c, g, or t
  misc_feature (898)..(898): n is a, c, g, or t
  misc_feature (914)..(914): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagcctgttcctcactcagcaccgcctgcaggccaatatggaatacctacatctccaccccagtgttgaaccctccacttggtgcacccaccggtctaccacctgccatttttcgattcgacgccaacgccttctactaataatctatgcccgcttccgtcctaattgcactggctactctcctcgatcctctataatctcatcgccccccctcgtccccccggctctcatcacccacacccctcagtgtaaccaccctgagccgccacgaggcatctaccgtctattattccagctacccctagtggaaagtaaccatgtccacgtccatgccacgtcacgcgcccttaattctacacaacatttcacctatatttactcccccccacctctataatactatcttgcacacctcatttcacctctgactcatcccctcaactaagaggtgactattacaccagatctctanacccgccgcccgcgan

SEQ ID NO: 310239 - DNA, 862 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatatggtctctccaactcccccaaataaactcgtccaccttatcctgccttttttaacccctggcctggtaaaattacttcctttcataaatacgataggattttcccccccccactctcactgccctgcttccgcccccccacttattcctctttactgtcaaagcgataatactacgcacacactcctagtcctctctcccccacacctatatattctcacactaccccatatttttctacgcccccccccacattaaacttccccgccctacgtcctccgcttctagcgagactccaagtctttcctcagatcccatcggtcgatgccttcacacgact

SEQ ID NO: 310240 - DNA, 659 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatcgacgtgagggtgtttaccagggctttggaaaacgccaagggggtggaacatgttggagttgagtgagacggtctgaaagcggtccgcgtagtgattgtgcctgtagaagcgcaggggctggggtaaggatgttagttttgcttaagagaatgagggtgtcggcacgcgcagagcgatgacgcgtctc

SEQ ID NO: 310241 - DNA, 666 bp, Homo sapiens
  misc_feature (1)..(1): n is a, c, g, or t
  misc_feature (666)..(666): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagcactattgtgaatcaggaaccagaagtgcgcgaaggcgcaagctggggaccgcagatcgtatactcgagagtcgaccttagccatgcagaacccgagagccttgacatcgtatagggaacttctcaaaatcacgtcctcatcaaagttgtgccttaacaagatgatgatggggtatcaggattagctcataaatccgacttagccctcccataattagtgtccgtgtacataggatn

SEQ ID NO: 310242 - DNA, 650 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagcgtgaggtatagttgtattgatgacaatcttgcaataatgataaaaggggcgtcgaaatcatctggagaatgtggtggttgctatggggaccgccgtggtcagacgatgttatctagatcagaaaattttttttgctaataggatgtgaagagatatggaaaagaggagtgtgggagagagcctggatagttgctaggatgacgggggaggcaagcagcgg

SEQ ID NO: 310243 - DNA, 920 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactattgaataatagctgccttcggctccctaactttaaattagcccgttattacaacatacctcgaatttacaccaaaggatacacactatcgcatttctacaccccacccattacataaaccgtcacgtgtacgttcacgcaacctttgttctagcacgccaggtttatcaactattacattccttattacttatcccaacagaccgcacatcattatgaagcgatcttctcgtcccaggcccgtcttacactcccacctttatacatcatgtcatctgcgttctgtcgcacgcttttaatgtgcttcgtccccagcatagctatatacgcccccccacttttctttcctcgcccacagtatgtccacgcttcttcgatgacgtgcgtgcatctagtagcctacataagagatgagatttacgcttaactttggtgcgtcaacctactctactgcttacacctatcccgtacccaactgccatgctcgattctatccctctctccgctagtctatatcaaccacaaccagactaccgtctcccaccgactccgtcacacaaatatacgcaccgtttttaccttctccccccccatgcaccatactcttatattatattt

SEQ ID NO: 310244 - DNA, 811 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactattctggacatcattttttccaaaagtcttggaaatgacaggaaatattgatgaagcagaatgggagtggaaagcaggaattacatgatggactggaaaaatcaatttaacgattacactagcaagaaagaaagttgtgtgggtctctaattaatagattttttcctttagatcaaggcaaaaatatcaggagcttttttacacacctactaaaaaagttattatgtagctttaacttagtattttacctagcatttcaaaacccaaatggctagaacatgtttaattaaatttcacaatataaagttctacagttaattaatggcctggttcaatttctttctttccttaataaatttaagttttttccccccaaaattatcagtgctctgcttttagtcacgtgtattttcattaccactcgtaaaaagtgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310245 - DNA, 871 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagaacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagattttttcctttagatcaaggcaaaaatatcaggagcttttttacacacctactaaaaaagttattatgtagctgaaacaaaaatgccagaaggataatattgattcctcacatccatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatcaatattaaaataaacacagaatgcggctcaaatctgtttgttttttatataaaggcaagaaagaatcttaaaatgagaggctcagccactttaaaacaccttataatagaaacagaatgctgcta

SEQ ID NO: 310246 - DNA, 679 bp, Homo sapiens
  misc_feature (1)..(1): n is a, c, g, or t
  misc_feature (549)..(549): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactattctggacatcattttttccaaaagtcttggaaatgacaggaaatattgatgaagcagaatgggagtggaaagcaggaattacatgatggactggaaaaatcaatttaacgattacactagcaagaaagaaagttgtgtgggtctctaattaatagattttttcctttagatcaaggcaaaaatatcaggagcttttttacacacctactaaaaaagttattatgtagctttaacttagtattttacctagcatttcaaaacccaaatggctagaacatgtttaattaaatttcacaatataaagttctacagttaattaatggcctggttcaatttctttctttccttaataaatttaagttttttccccccaaaaacaaaaaatagggcttcagtcgncaaataaagtacctcttagttaatatattagtatcctatctaactccattgaactagattttgctgtttgctaatataattcatttcactatagcgattttcgttattcacatataatggattaaaatct

SEQ ID NO: 310247 - DNA, 651 bp, Homo sapiens
  misc_feature (1)..(1): n is a, c, g, or t
ntcgttcggaaactgactctcttctgaaccagcgctacaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttatggattcataaatgtataatcttttactatattcacgagttattcttttttacctttgtcttcttagagtctagatggtcagaatattatatggcatcaacataataatttcatttctgaggtagggtctttcttccaaatagctgcttt

SEQ ID NO: 310248 - DNA, 656 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310249 - DNA, 600 bp, Homo sapiens
ggctaggtgcgaggccggggtgttggaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310250 - DNA, 721 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgacacaacaacaaaaacaaaagagcacaaaccttttgggcggccgaccccactccgaaacagttcc

SEQ ID NO: 310251 - DNA, 651 bp, Homo sapiens
gcttgcatagaacgcctgtctggtactggcaacagctcgagtcgtctgtacgtctctgtgtggtgtgctgatgtatagccctacatactagcatcaatgagtctgtagagataagttcctgtgttcttgcatcaaccagatagacaactgcccggcagtcataactgaacggtgctcgaacgacctgccgaattgagtgtgctgcgtggatcgtatgattgttactcgtaaatcattcacgcgcacgatcacgagagcgtacactcagtagtgatctatagactcgagagcacgcacgagcctcaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310252 - DNA, 457 bp, Homo sapiens
actcctgatctcaggtgatccacccgcctcggcctcccaaagtgctgggattataggtgtgagtcctgcgcccggccctatgattattttttaatcatttgttgtgtttgaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310253 - DNA, 295 bp, Homo sapiens
gcaattcttgtgcctcagactcccgagtagctgggatcacaggcgtgcaccaccatgccaggctaatattttgtatttttagtagagatggggttttgccatgttggtcaggctggtctccaactcctgacctcaggtgatccgcccgcctcggcctcccaaagtgctggcattacaggtgtgagccaccatgcccggccgatgtgatgggctggggtgattgggactgggaggtacagggtgagactgggagaaccaagtggttggaactgatatgaagagcctggcatggggg

SEQ ID NO: 310254 - DNA, 1108 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggttcagactgggatggggctccagagtgttagggagaggtggtgtgggtcctgggtctgagggaagagggactagagtcctcactgtctcagtggtttttgtttttgtatttgtttttttaaagaactgggtctcgctctgtcatccaggctggagtgcagtggcacaacctcggctcactgcaacctcctcctcctggggttcaagcaattctcctgcctcagcctcccaagtagtgggacgacaggcacacgccaccacacctggctactttttgtatttttagtagagtcagggtttcaccatattggccaggctggtctcgaactcctgaccttaagtgatccacccacctcagcctcccaaagtgctctcttacaggtgagccaccgtgcccagccactgtctcagtgtttgagtagatcataatgccgagacctctctctgcccaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310255 - DNA, 573 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310256 - DNA, 449 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcg

SEQ ID NO: 310257 - DNA, 665 bp, Homo sapiens
ggttggatgaaaccttcctcctactgcacagcccgcccccctacagccccggtccccacgcctagaagacagcggaactaagaaaagaagaggcctgtggacagaacaatcatgtgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgtcaaaacaaaaatactccatatttcatgggcttctcgttccgggggcggcccgtgttttgtcaatctttttccccaaggggaaaacgaatagacacgcggggtgaa

SEQ ID NO: 310258 - DNA, 868 bp, Homo sapiens
ggttggatgaaaccttcctcctactgcacagcccgcccccctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataaaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgaaaaaaaaaaaaaaaaaaaaaaagaaaaaaaaaaaaaaaaaaaaatggggggggcaagggccgaagaaggatctaaaaaaaacaagaggagggacggagccaacaaggacagcgaacagagcaaaagagccacgagaaaacacgggcaaaaagaggggggagccacccagaaaaaaaccggggggagacagagggtgcaaaacacacaaaaagaactgagagccaaaggggaaaaaaaaggagcaaagaagcgataaaaacg

SEQ ID NO: 310259 - DNA, 384 bp, Homo sapiens
atcttcccccacagaaggatgggagggcggtggtgagggcagatagggagggctgggcttgtgtcccccatggatcagggggagtgtctaatccctgtgtgccacccctccccagtgaaggtggacaaagaccggcagatggtggtgctggaggaagaatttcaggtgatgggctggggtgattgggactgggaggtacagggtgagactgggagaaccaagtggttggaactgatatgaagagcctggcatgggggtagaaagacctggagattggccgagcacagtggctcatgcctgtaatcccagcactttgggaggccgaggcaggtggatcacctgaggttgggagttcaagaccagcctggcaaacatggtgaaacc

SEQ ID NO: 310260 - DNA, 486 bp, Homo sapiens
tataggtgtgagtcctgcgcccggccctatgattattttttaatcatttgttgtgtttgaggtcagtaccctgagtcccagacatcaaccctgggttctcagactcagccaacatttcaaggctgtggactcaggtaatggctgttaagcctgggctgcaggccagagtcctgattttcaattccctttcacggtaggttcgtggtttacagctacaagtacgtgcatgacgatggccgagtgtcctaccctttgtgtttcatcttctccagccctgtgggtgagacacagctctactgtcctcaggagagggtcttcgattctgtgtgtgtgtgtttgtgtgtaaatgcgaatgtgtgcaggcacttgtgtaagagtgtgagcatgtgacagcctgtgtgtgactgggtgaggatgtgtgtgtgtcgcacgcatgatgtgggagggcagtgaagtggaggtgggggctcagattcaccaagagcc

SEQ ID NO: 310261 - DNA, 476 bp, Homo sapiens
  misc_feature (40)..(40): n is a, c, g, or t
ccgggtcgactactactactaaattcgcggccgcgtcgantgttcttctggcagataaccctacttaatctgaaagcatcagtgattttattatttctaataattaaataataagtaaaagtgactaccactcaatgtggaaaacttggaaaatacaaccacaatttggagaataaaatcaccaaaaagtctcacattcacaatatatcaactgttatttattttatgaatttgtgtatgtacccatatatatgtatgtttgctgtcatattatgtatttggcttgtaacctactttttatcatctgtaagtattctctaatattatttaaactcctttgaaaatatttttaagcctatataaaattgtcataagaatgtaccatagccttttaaagatttccctgatgttggatgtttagattgtttataatttatcagttataaaagtgctataattatattattgttcacaaa

SEQ ID NO: 310262 - DNA, 1731 bp, Homo sapiens
gaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310263 - DNA, 1697 bp, Homo sapiens
tcgctaggtagaggcgggtgtcaaatcggccgaggccgctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310264 - DNA, 1605 bp, Homo sapiens
gaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310265 - DNA, 1538 bp, Homo sapiens
gaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310266 - DNA, 590 bp, Homo sapiens
tcgctgtgtcgatctagaggtccctttggctcatgcagggttcgctccattcaggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310267 - DNA, 673 bp, Homo sapiens
gttgattccacaccgttggcactgactgttcttaaacgccttggccttgaccatgatctccacgcggctgtgggagaacttctcacgatgccgactcccccagattcaagaccagtgtgggcagcgccaagtatgtgccggagagaaacgtcgtgatttggagtattaagtctttcccggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310268 - DNA, 571 bp, Homo sapiens
ctctagaggaccctcagacagctggacccccatcggttaatgtttgagatcctacttacaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 310269 - DNA, 1008 bp, Homo sapiens
  misc_feature (955)..(955): n is a, c, g, or t
  misc_feature (978)..(978): n is a, c, g, or t
gaagcggcgccgccatcgcctcccggcgctccctccccgactcctaagtccttcggccgccaccatgtccgcctcggctgtcttcattctggacgttaagggcaaggtgaggctgggcatgaggagttgggagacggacagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccagtaagcctgtcggtggtcgctgggaggtcccaccggggganaggacggcggggtaaaacggcanggggaatgcgcggggccctaaatgggttgg

SEQ ID NO: 310270 - DNA, 317 bp, Homo sapiens
gaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccttagcgggtgttgcgggtccctccttcacagccgctgagcccagaggtcccgctggcccctcctctgaattttaggatgtcattaaaaagatgaatcta

SEQ ID NO: 310271 - DNA, 397 bp, Homo sapiens
agttccccatctggaaaacgcagggcacatgtaggctctccaatggcctccacattcctaaaacccagccagctaagaatgtctccagagaagatatttgtggcaaggagcccacacttgggtcttgcccccaggaactccccctgggaaaagttgagggtacagaactaagattggaaacctccacaagtctgacaggaacccagctccatcaggcatattgtggcatttctcagagtctctcctgttctccagcttcctccaagtgtgaattgttcattttatgttttccctgattccatcactcaattaaccccatagcaggtgccacctcctccatgccacctttagcacagcacaggaattactagaaacttctgtcctgcgaggaccggca

SEQ ID NO: 310272 - DNA, 419 bp, Homo sapiens
  misc_feature (9)..(9): n is a, c, g, or t
cccgggctngcaggaattcggcacgagagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattc

SEQ ID NO: 310273 - DNA, 3181 bp, Homo sapiens
  misc_feature (119)..(119): n is a, c, g, or t
gcacagcggcgcgctcgcaccgctcggctccgcgcggctctaggaggtggcggcggtggcggtggcggcggtggcggcggcggcggcggcggggcgcagggctgagcgagcgtccgggntccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatg

SEQ ID NO: 310274 - DNA, 255 bp, Homo sapiens
gcacgaggactgcatcttttttcaatataaagggatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattc

SEQ ID NO: 310275 - DNA, 6195 bp, Homo sapiens
  misc_feature (119)..(119): n is a, c, g, or t
gcacagcggcgcgctcgcaccgctcggctccgcgcggctctaggaggtggcggcggtggcggtggcggcggtggcggcggcggcggcggcggggcgcagggctgagcgagcgtccgggntccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttgtttaatacatgtggaccatgaacagtattcattctcctttttcaaatgatatgctgtagaaaatattccttgaagatgtgagatttaaaaatttttccctttcaatgttgttttaattgtatttcttacttggtttttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattc

SEQ ID NO: 310276 - DNA, 6136 bp, Homo sapiens
  misc_feature (119)..(119): n is a, c, g, or t
gcacagcggcgcgctcgcaccgctcggctccgcgcggctctaggaggtggcggcggtggcggtggcggcggtggcggcggcggcggcggcggggcgcagggctgagcgagcgtccgggntccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaattaatacatgtggaccatgaacagtattcattctcctttttcaaatgatatgctgtagaaaatattccttgaagatgtgagatttaaaaatttttccctttcaatgttgttttaattgtatttcttacttggtttttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattc

SEQ ID NO: 310277 - DNA, 6141 bp, Homo sapiens
  misc_feature (119)..(119): n is a, c, g, or t
gcacagcggcgcgctcgcaccgctcggctccgcgcggctctaggaggtggcggcggtggcggtggcggcggtggcggcggcggcggcggcggggcgcagggctgagcgagcgtccgggntccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttgtttaatacatgtggaccatgaacagtattcattctcctttttcaaatgatatgctgtagaaaatattccttgaagatgtgagatttaaaaatttttccctttcaatgttgttttaattgtatttcttacttggtttttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattc

SEQ ID NO: 310278 - DNA, 4225 bp, Homo sapiens
  misc_feature (119)..(119): n is a, c, g, or t
  misc_feature (4001)..(4001): n is a, c, g, or t
  misc_feature (4225)..(4225): n is a, c, g, or t
gcacagcggcgcgctcgcaccgctcggctccgcgcggctctaggaggtggcggcggtggcggtggcggcggtggcggcggcggcggcggcggggcgcagggctgagcgagcgtccgggntccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctgcgtgctctattccactgccttgtacatagagatcatattaactgcaccctcgaacacccagcctcccccgccccgtatattatttcaaccgcctgcccctctcctcctcacgcgcccgcaacccctcctcctctccccagcgccctcnctccctcttcacatttcaccccttctccagtaccctcgctttcttaacactactttacaggctgcggatccacccccgcctgactcttttttctccccaccacgcctcattctccttctctgccgtcccttctcccctcccgtccccacctccctctacgtcatctcacttcttttgagcctcctcctctgtctccgcacgcctccctctttctcttctccccn

SEQ ID NO: 310279 - DNA, 2914 bp, Homo sapiens
gaattcagagggaccagcccaggtggggcaggcagaaaactccggagggataattggcagggcagttcggtcctcccagtttccgctaagacacaaattactcagcgggcagtggcgcttggctggcatcacctgcaattaccttaatagggcgggaaggcggtgcagcagtggtggtcggggcagccccgctctgctgcatgcctgcgatgggagggacggagtctccaggttccagccgtctcatggctagggaagtttccagaaacccgctggaccctctcttctccaccaagcctctcacctgtctgttctctccccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatgcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgtttaaaaaaattc

SEQ ID NO: 310280 - DNA, 2684 bp, Homo sapiens
gaattcagagggaccagcccaggtggggcaggcagaaaactccggagggataattggcagggcagttcggtcctcccagtttccgctaagacacaaattactcagcgggcagtggcgcttggctggcatcacctgcaattaccttaatagggcgggaaggcggtgcagcagtggtggtcggggcagccccgctctgctgcatgcctgcgatgggagggacggagtctccaggttccagccgtctcatggctagggaagtttccagaaacccgctggaccctctcttctccaccaagcctctcacctgtctgttctctccccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatgcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgtttaaaaaaattc

SEQ ID NO: 310281 - DNA, 2656 bp, Homo sapiens
agcgggccttccggcctggggcacccgcggcggcgtcgaggctgcgggcgggcgggcgggcgcagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatgcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgtttaaaaaaattc

SEQ ID NO: 310282 - DNA, 1439 bp, Homo sapiens
agcgggccttccggcctggggcacccgcggcggcgtcgaggctgcgggcgggcgggcgggcgcagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgcca

SEQ ID NO: 310283 - DNA, 2408 bp, Homo sapiens
gatctactgctttggccttggtaaattatattctccaggatgcatatttgggtgggcaagagaaggaatatgaaggcatggtggcccctcaggctcacctcctctgcagagaactgctgctcctgcagtgatgtgctgctgctggggctggatagcagccatggtactatgacagtgtcctccctcaaccccggccatcccttagccctccagtccctggctagacaattccttgcacataaactaaactacttagtcatttaggagcaaatggagatgtaataaactgggctagatcatttcttgactgttattttctttaagttttcactgttaagatcaaatgaaaaataatgccaaaggagttttttcttcaaaggtttgaaaagaattttcatagaaagcgaaaaatggcagtaatgtatatgttaattaagaccaagttataataatagcctttgtgtagtgctttgagaatacttttacatacacaattgtgttggatgatttaataatgtatcgaccaggaaaatgagaaagcacccctcccccttaccttttacattgaaggtagcccagacttggcagcctctagggaaccagcaaggtcagagtccatcacacaactttcctgctaaagtggtatttgccaaatcatgtccagaggtgttgtttctacaatcttcttggcaactccgaaatgggctgcatttggggcacttccttttgccatccttctggcccttcttgcccgtcaaaagcttttgtctgtgggctttggaaatagtccagtttttaaggtgttttatttttcagagttaatggtttcttgactaatcagactatgaaaatgccttctctaggttctttaatagttataccaagtgttattcccattttaggaatgaagaaactaaggctgacaggcaaaggtcatgtagccagcatgtggcaacactagaataaattggcagactcaacaccattagcagacctgtctggagggaatggtgggtcttgaactttcaagtaccctctaaactttttcagcaggaatttcagaagtctcaagaattctgagctccctgctggccatgggacattgtgctgatatggtgggaaaaatgcaggttgagaaagccttcgcatcctgccctgttggaggctggtgtttgggatgggtatgaaggcctttggcggtggctatagcttatgcagacctgaagcaatatacctctgggatggaagatcctgcttattttgggataatttctaaatctgtcatatctatccccaaccctgtccccattaaatggctaattgccaaaaaagaggaagcaacatcttcagctctagcaagtctcggggatgtctcactcattgtgaggactgtgaggattcggtatatatttttaagtgagtgaaccttgttacatgttttaaccttggttcctcctgtcaagaattttatcttctcatgtcttgggcaccttttccctctacccagatcaaatagcaaaatgcttagttaatctttgagaggatagaatccatgggaagcacaggatgaaatgatgacgctgtgctaagctgtgtcaccgtgggtaagcccctgcccttgctgtgactttccacttcctaaattagaatggaagggggaaaaaaaaaaaccataacccaacttcatttttatgagtggccctttagaaaatagtgtaatccgttgagtttccattgtacctttcctcagagatgctcaaaggggcgggggtgcccttacatggaacatgatgagagtgaggattaatcactcccagtcctctgggaggggggaagtgacctgaactttctaattgaaaaagtaggaagtgtgtgcccaatgcccagatgagtgggaagattactgtagttgattgaggaaatgccgtatttatcattcacccttcccatgacctttgtttttccctaatgccttaaaaaataataaggaaacattgtcctacctgattctaccactgttcatctcacgcagtgtgcactccctgactctgaattttgcagctttgagactgaggtaattgagactgatagggatttaaggatatttggttcccacaagaataagctaatattaagttattattttacttgtggagaagaactaaattgtataagctgcctggttcttctagacacacattgcctagtgaaaaaattaaaattttgaagaaaaagcagttttacttgttaatacttgccatgtgtctcacccacaaatagcctcatttaaaactttgccttacctagcatgaatggataaagaaaaaggagagttattagggaatctaaattcccaactaactttagcactgatagtggtgaagctatgggcaagacatttattttgt

SEQ ID NO: 310284 - DNA, 431 bp, Homo sapiens
agacataagctgaacctctggcctgcagttccagatccaaggtgactgagacaaactgccagctgccactggcttatcaggagcacctggagatggacgacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacctaaaaaca

SEQ ID NO: 310285 - DNA, 594 bp, Homo sapiens
agacataagctgaacctctggcctgcagttccagatccaaggtgactgagacaaactgccagctgccactggcttatcaggagcacctgaatctgctgacacatcaaggccacttttcttaggagccccctgacttccaaaatcagtgcctttggattcatctcttccgggagagttcagtgtcttctgaaatgttacaaaacgtccttcagagcaagaaggcgtacacgaggagctcgactctgtagaaaggagatggacgacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacctaaaaaca

SEQ ID NO: 310286 - DNA, 543 bp, Homo sapiens
cttgaacctggaaggtggaggttgcagtgagccgctatcgtgccactgcactccaacctgggctatagagtgagactctgtctcaaaataaaagaagaagaaaaaaaaacacacaagagtttaaacctgaaatgacatgaagacttaggcgactggcgagagagaatcaaagaaagttgtgtcactgcaccatggagtctggtggtgattgaagtccgttcagcacaggtgctcaggacctgcggacttgggcagagggcattgtaagcagctagagaacaagagagggcagagacagcttatctctgcttgacaaggcccagcattatggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccacctaaaaaca

SEQ ID NO: 310287 - DNA, 349 bp, Homo sapiens
  misc_feature (4)..(4): n is a, c, g, or t
  misc_feature (6)..(7): n is a, c, g, or t
  misc_feature (9)..(10): n is a, c, g, or t
  misc_feature (40)..(40): n is a, c, g, or t
gctncnncnnctactactactactaaattcgcggccgcgncagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtacta

SEQ ID NO: 310288 - DNA, 406 bp, Homo sapiens
gctggttatcctggataatcttggtatctttgcagttaagaggttcatcaacggttctattatgccacagtgaacaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtacta

SEQ ID NO: 310289 - DNA, 1013 bp, Homo sapiens
  misc_feature (64)..(64): n is a, c, g, or t
  misc_feature (913)..(913): n is a, c, g, or t
cagtgatgatagtacgggcgggtgttaatcaggacgagggggtgcgcgagccgtaacggtcttngagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgaaccactgttgggtctccttgcagtcctgatatgtcatctttagcatgtggctacttacgtaatcttacctggacactttctaatctttgccgcaacaagatctgccccganaatgctgtgggcagatcttcctaccttgcggccgctcaagatccagtttcaaacgcgggtttccctttgggccccgacctggcggcggccggttgccccg

SEQ ID NO: 310290 - DNA, 9678 bp, Homo sapiens
  misc_feature (1)..(1): n is a, c, g, or t
  misc_feature (5)..(5): n is a, c, g, or t
  misc_feature (8)..(8): n is a, c, g, or t
  misc_feature (14)..(14): n is a, c, g, or t
  misc_feature (18)..(18): n is a, c, g, or t
  misc_feature (27)..(27): n is a, c, g, or t
  misc_feature (29)..(30): n is a, c, g, or t
  misc_feature (45)..(45): n is a, c, g, or t
  misc_feature (52)..(52): n is a, c, g, or t
  misc_feature (59)..(59): n is a, c, g, or t
  misc_feature (63)..(63): n is a, c, g, or t
  misc_feature (86)..(86): n is a, c, g, or t
  misc_feature (173)..(173): n is a, c, g, or t
  misc_feature (179)..(179): n is a, c, g, or t
  misc_feature (181)..(183): n is a, c, g, or t
  misc_feature (189)..(189): n is a, c, g, or t
  misc_feature (192)..(192): n is a, c, g, or t
  misc_feature (210)..(210): n is a, c, g, or t
  misc_feature (259)..(259): n is a, c, g, or t
  misc_feature (355)..(355): n is a, c, g, or t
  misc_feature (387)..(387): n is a, c, g, or t
  misc_feature (451)..(451): n is a, c, g, or t
ngccnccnctgcgnccgnccctccccntnngctttccttctcccnccgcctnggctccnacangaggggccggcggggcaggccgnccaagcagcccgcggctcccgctgcggagcgctgcgccccggccccgccgccgccgccgcccacgtccggacccatcgggggctccnctcgcngnnncgcggnagnagccggggcaggtgggcngccgccaggctgaggtggcgcccaagacgcggctgagctcgcccagggngggcagcagtagccggaggaagccgccgccgccgccgccggccccccccagcaccagcgccccgggccggggggggcgaggaggcgggggcggcangacggggggcgggggcggcggcggccacctgncccggaccaccgcggcccggagggccgtcaacaaagtggtgtacgatgaccacgagagcgaggnggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggtaggtgatttcacatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcacaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccactaagagtaaaaccaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcaccaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggttcctccaggaggagggagtacacggacagaaacatccgaaactgaaatcacaacaacagaaataattaagaggagagatgttggtccttatggcattcgatttgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaagttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcaaaagcccagccacagactgctcagccttcagctcggccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttagtgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagttcttccagcccctccagcccctccaccttcacctccccctccacctggtgtgcaacacacaggccttctgtccacgcccaccttacctgttgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaatttagtccaacggacaagaaaaaagccaagtcaacgacaccattatctgtcaagatcagatggtttactattgtggcgaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtccttgggctacagactctgttgccttgaatataacagtacaatttgtcaattactctgcaccaggctaaagtgagtaaaatctatttgaaggtatcttgtttgtaaacatttgtcagattctaatttttttcttttgtattaaaattcaactatggatgtatatgaaacaaaataaatggagataatttttctcccac

SEQ ID NO: 310291 - DNA, 1022 bp, Homo sapiens
tattttgaccatttatcttctacacctggctgacctgcatggtccttgtagtgtaacttctacttggtgtttgcgctttgctttgttttcaaatttaaattgtgagatacatttttaaacctatctaagaaatagccctgatattgaaatggcttctgtggaataggtttgacagatgtaagtctttgattctttggctttggtttttgtgcttgttacagttttacacacattcattcagaggaagacattaccatcaatgtgttgtttcttttttcaaattccagtatgtttttaaagacccatatttcactaagcagtgtacttgttgaaactgatgtgagtgactttatgtttccacatgtgatagagcatcagatactggagtttgccaggggtagaatggttggattcagaaatgtttagctgactcattgcaggaagttacactgtaaaaaagtgaatcaaggcagggaagacagatttaagtaccatgcagctcaaaatgacaattacattgtcattttcattgtgaatacttttaggttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacagtgagttctgataagagcatcacatttaataatttaggaagccaaattgctctgactggttacttatttactttaaaataaaaagcagattttttctacatttgttatacacttacattacaaattccttttcattttttttttctctttttccctttttacctacccttcaaaatttatcttgcttcatagtgaatgtttgagacacattggggaaaatgtggtttaatggtagatttgattcttcaatatgtaacatagaaattaatgagattaaaatagcctgacttgtttggactttat

SEQ ID NO: 310292 - DNA, 3023 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310293 - DNA, 2202 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaaaaaaaaaaacaagggcaaccaaaaaaaaaaattttgggggcgcgcgcgccccaagaaatttacacactttgggggcggcgccccgagaaaaaggctgttccacaaacacgcggcgagagggggttcccccaaacacgggggggggtgaaccccaggggggggttggctcagggcgcaccag

SEQ ID NO: 310294 - DNA, 3089 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgttccaccaactataccagtggtggaacaggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310295 - DNA, 3000 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310296 - DNA, 4821 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310297 - DNA, 4428 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310298 - DNA, 2005 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtgcattacatcccagtctgcacctgtat

SEQ ID NO: 310299 - DNA, 3555 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaataaagaaatatttgcttactattaaacttgagggggggcccggcccccaattcgccttttgggagtcgttttacaattcacgggcggctgtttacaaccgtgtgactgggaaaacccctggggttccca

SEQ ID NO: 310300 - DNA, 4616 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310301 - DNA, 3695 bp, Homo sapiens
  misc_feature (3445)..(3445): n is a, c, g, or t
  misc_feature (3463)..(3463): n is a, c, g, or t
  misc_feature (3509)..(3509): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaaaaaaaaaaaaaaaaaaaanaaaaaaaaaaaaaaaaanaaaaaaaaaaaaaaaaaaaaaagagggggggggaaaaaaaaataanaaaaaaaaaaaaaacaaagaaaaacagaaaaaacaaaacaaaaaacacaaacgaagaacaaaaaaacaaatcatagaaagagagggcggggcgcatcacaaaatgccacgactcgcagcgcgcgacacaacaacaagacaccaacaccctatttagagactagaagacccaccacgagagcggcac

SEQ ID NO: 310302 - DNA, 4374 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310303 - DNA, 2580 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaaaggtccaacgccaaaaaaatcacaccacaaacaacaacacaccgaaaaacattgtgggcgcggccggcttcttcgggcccttcgaaaaagagcgcttcaacacaagcacaacttcggagttggcggccacgggcgccaccgataagcgaaaggagaaactgcgggcaaacaacggtggtcccccaaaggaagaacaccgggggcacaagaacaaaaggcgcgcggaggaggtcccccccagatataaaaaagacgccgcggggggaacaccacaagagagatttaagtggaaaacaaataccacaagcaggaggaccaacagagcgggccaaaacccggggggcatcccaataacaacaaagggggagcgccacacaacagagggggccgatcacagacaaacacaaaaaaagtaaaccgccccacatctggggggggcaaacacccgagcagaagcggcagcgagagagcagaaccacacgagacagagcaccaaggcaagaagagagaacacggacaaagacacaacaacagaagaaaaggacaacgaaagacgacacaaaaggacagcaagcatacagcgcagat

SEQ ID NO: 310304 - DNA, 3487 bp, Homo sapiens
  misc_feature (3255)..(3255): n is a, c, g, or t
  misc_feature (3301)..(3301): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaaaaaaaaaaaaaaaaanaaaaaaaaaaaaaaaaaaaaaagagggggggggaaaaaaaaataanaaaaaaaaaaaaaacaaagaaaaacagaaaaaacaaaacaaaaaacacaaacgaagaacaaaaaaacaaatcatagaaagagagggcggggcgcatcacaaaatgccacgactcgcagcgcgcgacacaacaacaagacaccaacaccctatttagagactagaagacccaccacgagagcggcac

SEQ ID NO: 310305 - DNA, 4162 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310306 - DNA, 4798 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310307 - DNA, 4593 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310308 - DNA, 2470 bp, Homo sapiens
  misc_feature (2238)..(2238): n is a, c, g, or t
  misc_feature (2284)..(2284): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtaggtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgaaaaaaaaaaaaaaaaanaaaaaaaaaaaaaaaaaaaaaagagggggggggaaaaaaaaataanaaaaaaaaaaaaaacaaagaaaaacagaaaaaacaaaacaaaaaacacaaacgaagaacaaaaaaacaaatcatagaaagagagggcggggcgcatcacaaaatgccacgactcgcagcgcgcgacacaacaacaagacaccaacaccctatttagagactagaagacccaccacgagagcggcac

SEQ ID NO: 310309 - DNA, 4371 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310310 - DNA, 3023 bp, Homo sapiens; identical to SEQ ID NO: 310292

SEQ ID NO: 310311 - DNA, 1791 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtacta

SEQ ID NO: 310312 - DNA, 3784 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatacaggatgctgcaagataggaaattccacatagaaattagaaacctagtcagaggacaagcttcatacagtgtcgacgc

SEQ ID NO: 310313 - DNA, 3822 bp, Homo sapiens
  misc_feature (3815)..(3815): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgtgagattttaaaagtcaccagattagtttcaaatgaacagccttgagaatcttagaatatcttgagggtaagttaacgggtgtcattgtaggaggtgatagagaagtaggccaaacccaccaccatgctctgggcctaatacagtcttttcctattgaaaagtgacggttggggaagaaaaaaaatctcggcctgtttctgttactgtagtagctagcacttatgaattggcaaagtttcagagaccctccctcccctatgtcagatactacaataccatacaggattaaaggtgtaatatgcagatcaagacctagagattaaatacagacttcaggtaggctgctgcttggaatacttattatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttagctataccaccacaccagtcagaatgggtattattaaaaagtcaaaaaaataacagatgctgatgaggttgtggagaaacaggaacgcttctacactgttggtgggaatgtaaattagttccagtattgcagaagacagtgcgcgattccactagcctagtgtatagctgatcccctcngtataag

SEQ ID NO: 310314 - DNA, 3196 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttagctttggtttctacaaattattttattagaatgtcagactcaaaaggaactaccagtaacatgcctgaacatgctatatatgatttatgcttgacccgtgacacctgctgtcactggatccagagtgtgaacaagggaaaaggacagtggatgtgggcagggacagcaccagccctggctggccagacctcaggcccacagacgtggtccccataaccaccaggatccctacaatatacacattcctaattcaggctcaactctcctttacccaagagtaaatgcctcaggactcaatctgaatcactgtccgtctcggcttctttcacatccatgctgaatttgtactcctggtcacatcccatgtaagcatcactcatgaagtatagagtgtagttgtgggcaccagtggctggagccacaaagtccaacttcaccttggccttctgctgcaggatcagcctcttgatggagatgaggctattggacttggtgtctccaatcaccacccaccagccctcttcacgtttctgcgggaagagaggcgcaatgacagggcctgtgacttcctcctctcgctccagctgcaccagcacatccgtactggcccgccactgcggatgctgtccttatccaccacctcctaagatagttcgatattagggtagcagttacaaaagcgagccacatctgtaatctggctgtcagtcagctgaagaattgtgttccgttcttcatcctccatctccatgatgtcgaaaacactcttcactcccttgtctgtgcaacgtttgatatgctcagagatgaagtgtggcagctgcttcaggtatgagtccttggaccacatggcttgggtgaccatctgggccaattccatagctgccagagcagagctgagccacccattgctggagaggacatccacgcaggcctggacgagccggactgccttactaaggatttcctccgtatctgactgcaactcagcactcagctgcatgcgggacaggtgagcctgcaggagcaggttggtcttgatgtgcggatcattgaacttagggttattcagcttgtcagggaccttctgagccaactgcctcaggaagttttcttcatggtgctggatggggatattctcgtaccctgctgcattggagatgatctcaataagccctcgcaccttggtcttggcgttgaggaagaggaagatcaaaacgttgtaccagaaactacctctgaaggctacactttccaagttcaggatggggctcctgggacctttaacttttagatcatgtagctgagacataaatttgttgtgtacta

SEQ ID NO: 310315 - DNA, 1891 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttagggctgaaaataaaaatctgtctctcataaaaaaaatgctgactactttggga

SEQ ID NO: 310316 - DNA, 2062 bp, Homo sapiens
  misc_feature (1812)..(1812): n is a, c, g, or t
  misc_feature (1830)..(1830): n is a, c, g, or t
  misc_feature (1876)..(1876): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactaaaaaaaaaaaaaaaaaaaaanaaaaaaaaaaaaaaaaanaaaaaaaaaaaaaaaaaaaaaagagggggggggaaaaaaaaataanaaaaaaaaaaaaaacaaagaaaaacagaaaaaacaaaacaaaaaacacaaacgaagaacaaaaaaacaaatcatagaaagagagggcggggcgcatcacaaaatgccacgactcgcagcgcgcgacacaacaacaagacaccaacaccctatttagagactagaagacccaccacgagagcggcac

SEQ ID NO: 310317 - DNA, 1785 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaaaagttaaaggtccccaggagccccatcctgaacttggaaagtgtagccttcagaggtagtttctg

SEQ ID NO: 310318 - DNA, 1628 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtattaactgcttgggggtcctctagagtaagcccg

SEQ ID NO: 310319 - DNA, 2042 bp, Homo sapiens
  misc_feature (1856)..(1856): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtatataaggcttcattaagcttaactgagaagtatttctctgtagaggtgagtaatggatggtaatattaataacaacttggaaaaatgtaaagccaaggccatgagcccttttttccctcatacttttaaaaatgagcctcatatctttgttaaatatagtaaaatatcagtgtgcataggacgtaatgtacttattgcccctctgatgtttggcttgatggtaataaaatctatttatttatttatttaaaaaaaaataanaaaaaaaaaaaaaacaaagaaaaacagaaaaaacaaaacaaaaaacacaaacgaagaacaaaaaaacaaatcatagaaagagagggcggggcgcatcacaaaatgccacgactcgcagcgcgcgacacaacaacaagacaccaacaccctatttagagactagaagacccaccacgagagcggcac

SEQ ID NO: 310320 - DNA, 3022 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgaaccactgttgggtctccttgcagtcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310321 - DNA, 3091 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgaaccactgttgggtctccttgcagtgggtcaactgcaccgtacttaataaccaagtctcggaacactgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310322 - DNA, 990 bp, Homo sapiens
  misc_feature (927)..(927): n is a, c, g, or t
  misc_feature (965)..(965): n is a, c, g, or t
  misc_feature (976)..(976): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaattctggacccccgaatagatgctgttgaagcaaatcttnctaccttaatttccggtcccggcatcctgaatgatccnaaaatttttanccaaattcctggct

SEQ ID NO: 310323 - DNA, 2944 bp, Homo sapiens
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaataccgtaaatttaatcataaatctctgctggagctacaaatggaattctttcctcccaaacttcaaggctgaatggggttccaaggtaaatcacggctgcacatgggcctcacctgggaatgtacccagttctgtttcgttgatgaggggcatgagggtccaccttgtgtcttttttaaaaatgtaattcccaagggctcttgtacaatatagattgatcaccactattctttttgagatggagtctcgctctgtcacccaggcgaaacccgtgtctctagtaaaaatacaaacaattagctgggattacaggcatggtggtgggagcctgtaatcccagctactcaggaggctgagtgcaggagaatcgcttgaactccggaggttggaggttgcagtgaggctgagaatggcgccactgcagatcccagccttggtgacgagaagcgaaaacacttggtctaacaaaaaaaatccccctgtggcataagtatatcattaccctaataacttctgacgagtcaggataagggaacaaggaaggaaagcaaagggagcaggcaaaccgggtaattacgttcccgaaatagccaattgagagcaaagtcacattagatacgaaaactggctgacagccctaaacatgtagccatgcgtcgcaacagtaacatctgcacgaaacaagtcaccagtaaaacgaaattgatccaggggctgacagagaagacacacaacgaagacacaaagggacggagcggccggcaaacaaatcaccatcaaagggggccaccaggtcagtggcgaccacccagcaacatcagag

SEQ ID NO: 310324 - DNA, 1125 bp, Homo sapiens
  misc_feature (910)..(910): n is a, c, g, or t
  misc_feature (915)..(915): n is a, c, g, or t
  misc_feature (925)..(925): n is a, c, g, or t
  misc_feature (927)..(927): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctggaccccgataatgcggntgggnagattcttcnancttagtcgggccggatcatgaggatccgaagggttagcaaagaccggggggatatcctacctatgggtgcgccatgaacggttgctgggggggaaacagggttggtccccctggagctgagagctagatgcaggagacccagacacgaagaagatggcaaacaacggtgagagagaagcgtcaggtacaaataagagg

SEQ ID NO: 310325 - DNA, 956 bp, Homo sapiens
  misc_feature (796)..(796): n is a, c, g, or t
  misc_feature (831)..(832): n is a, c, g, or t
  misc_feature (860)..(860): n is a, c, g, or t
  misc_feature (874)..(874): n is a, c, g, or t
  misc_feature (924)..(924): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgaaccacatgtntggttctccttgccagtcctgatatgtcatctttnngcatgtggttacttacgtaatcttaccnggacctttctaatnttggcgcgaaagaatctggccccgatagatggtgggcgatcttcctactnagggccgggcacagagatccaaaggtgcaacc

SEQ ID NO: 310326 - DNA, 997 bp, Homo sapiens
  misc_feature (897)..(897): n is a, c, g, or t
ggggaaatttaaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgaaccactgttgggtctccttgcagtcctgatatgtcatctttagcatgtggctacttacgtaatcttacctggacactttctaatctttgccgcaacaagatctgccccganaatgctgtgggcagatcttcctaccttgcggccgctcaagatccagtttcaaacgcgggtttccctttgggccccgacctggcggcggccggttgccccg

SEQ ID NO: 310327 - DNA, 404 bp, Homo sapiens
ttttagatatcatttctcagagtaaatcaagtttgagtgagacctgcagggttttcttgtgagcgcctatattgagttttagtgcataagctttgttttaagttttcactgggtagatgaactgtcagataagtggcattatgtctaacatataaagtatttccccccatttttaaacagagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatg

SEQ ID NO: 310328 - DNA, 1542 bp, Homo sapiens
gtggcctaccatggtttcaacgggtaacggggaataagggttcgagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310329 - DNA, 753 bp, Homo sapiens
aattctaagaatcaggaaaatgctttagaaaaattacattgtaaaagggaatgttactaagaacctttcttatggggtaaaaggatatgccacgacaaaggcccatatctagctgtgattgaatctggaagcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttata

SEQ ID NO: 310330 - DNA, 1542 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttata

SEQ ID NO: 310331 - DNA, 1652 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310332 - DNA, 1807 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaaaaaaaaaaaaaaaaaaaaaaaaaatttgggggcgggcgaaaatttcaaccattttggggcggccaagaaggaaaggcagtggcaagaaacggcaaaggtggtttcacaaaaagcggggcgggtggaaaacagggtgggcttggtacaggcaggag

SEQ ID NO: 310333 - DNA, 1378 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataa

SEQ ID NO: 310334 - DNA, 1598 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttataaaaattacatggccgtcgtattaccgttctgattgtgcccttggggtacctccttt

SEQ ID NO: 310335 - DNA, 1471 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctgccaccgtcatcgcaccgttgtgaaataccacggcccctccccgcaggcatgcctgcgcatcgactact

SEQ ID NO: 310336 - DNA, 1804 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataaaaaaaaaaaaaaaaaaaaaaaaaaaaaaaaaaaaaagaaaaaaaacccggggacacatagacgggagcgacaaagacggtcaaaaagagacacgggcacacaaggtacccagacaccatttgtgtacacaaggtgcgacacacgcggaggcccaaaagagaggcaaaatcgcaaaccacgggaccccatagtcaccgcgacacagaagcaaacaaaagaaaagaaacagacgcgacgcggggggggggatcgcacaaatggcgacaacaacacgggcggccagccgaaacacgacaacgacaccgtgaaacaacaggcgcgacgaggaacaaaaacacaagataatgcagaaagagcaggacaagaaaaacagccgacaccgggcagacagaccgagagctgcacacgacagaaccacatacgaca

SEQ ID NO: 310337 - DNA, 1598 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310338 - DNA, 1559 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310339 - DNA, 1694 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggatttgagtaacaacagataccatatggccagcaaagcctaagtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310340 - DNA, 1613 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310341 - DNA, 1284 bp, Homo sapiens
  misc_feature (25)..(25): n is a, c, g, or t
  misc_feature (28)..(28): n is a, c, g, or t
  misc_feature (43)..(43): n is a, c, g, or t
aggcgagtcgggtaatgaagatcgngtnaggagcaggacgatncccaaggaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310342 - DNA, 1469 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310343 - DNA, 1311 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataa

SEQ ID NO: 310344 - DNA, 1205 bp, Homo sapiens
gctctctgccattttttgatgggggttggtgagggcgtctgacctgaaggaggaggccagatgcagctatttataaagtttttagggaatagagatctcaagagaagattgcatgtccttgctgtccccctggccgccagtggtcactgagccatcttctccccatttcccaggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310345 - DNA, 1543 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310346 - DNA, 1470 bp, Homo sapiens
cgggcgtgcacgccgctagcgcacacgccgacgggcgcgcgcggcgtccctctggcgggtggcgcgggcgggcgcggctcggtcgaaggcatcggactgccgagcggctgcggacggatgcggggggggtgcggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310347 - DNA, 1585 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggatttgagtaacaacagataccatatggccagcaaagcctaagtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310348 - DNA, 1450 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310349 - DNA, 1309 bp, Homo sapiens
agcatatggacatcgaccatctccagccatctggctaccaagcatctcaaggaaggaggcctcctgaccttggctggcgcaaaggctgccctggatgggactcctggtatgatcgggtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtttatctgtgtccattgcagggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310350 - DNA, 1272 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccagaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310351 - DNA, 1459 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310352 - DNA, 1634 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgagccgacactcccaccacacttgagatactgatctaagacctactctagatggaacatctgggatcttgtgtctgaactcgtgctgagccacagacccacagaggacgggctgtcacaggcccccttttgttctagagatcacatccacccatttgtggtatttgaaaactctcagaaaagctggcataaagtttgctttgagatgtctgtgagcacatccttcctctaccatccctggttagaatggcgttctcactcacctatccacgctgcagatgagggtgaagaagtaaaaccatttaaaacatgcatcgcagcaaaccaacatggcacatgcatacctgtgtagcaaacctgcacgctgtgcacatgtagcctagatcttaaagtataaaaaaacaaaacaacaaaaaaacatgtgtaaccaacacacaaaaccctacacaaccaaacggcactggtctctttcagagccttccctcaccaagccctaccctgtccccagagatgaggccatgacatgacagtactttagagagttttagcaacgctttgttttttgagcccatgtgctcatatgagcttgttcaaaccccagagtaggggcctgaatgactggacctttacacatcagcgctggcccagaaggttacagattggcactgggagtctcccaggaaggaaatgctgagcactttttagttaatgaaggtccgaagtctcagctggtgaattgtcaaaatggatgatgtactcaaatgtaaatgttttgtgttaaagaattattcatctacttcttgtttcttgtgaatttcttttgc

SEQ ID NO: 310353 - DNA, 1365 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310354 - DNA, 1204 bp, Homo sapiens
ggctcaggaagcctaatccaggtggtaaccacagaagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctggtgttctcagaagggggtggatttaaatcctgaaataaatatttcaacacaa

SEQ ID NO: 310355 - DNA, 1117 bp, Homo sapiens
agttacagtccctccgggtggcggggcgccgcgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggcctaccaagaccaagagctaggcgcaaaaagcaacccagagaaaggacaccaagaaaaaacagatagcagacaaagccaaaaagagcaatcaccagcgacgatccagagcctaggctaaggaaggaacaagcggcaaagccagcccgagaattcatgccatgcagacagcgagaagcggcccaggtggagcgcgagagagagctgccagagatatgcatggaaaatctatagcgcagatatcgagatcaacagggcgtaccgagagacacctcgaaaggaagagcctaagagaaagacaacgaggagctccataaaacggaaataggacaacgagcaagaaaaggaaagccggatccgaagatcccacaagaaaaaggcccggagaaaccaagataaaatgaaaacccgcggatgagtatttaacagagagccgaaaactgaacaagccgccgaagtcgtgaagaaagtgggattatcccacctagaacagctagaggcgcaagaaaagaataattgtcccgaagcgccggaaaggtagtacacgagagac

SEQ ID NO: 310356 - DNA, 1186 bp, Homo sapiens
atgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 310357 - DNA, 2785 bp, Homo sapiens
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctgttttccacagaggtagtgaaaagaactggattttcaagttcactttgcaagagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttctttctgttgtgcattcagtttctaaaaccattaagtttctactccatttacattcaaaaatcttaaatactttacttgcaagagtattttgcttcaaatacaacaacctaagagcagctggagatgaaatattgggaaattcatttgcttactcctgaagacaaaaatatagctgagatgaccactggatttaatatcgttatgctggcccaacattgctaccatttgtgttgtctgtgatcaaaatgattatcttttatataggaagatgacgcttctggatattgctttcacttcttctccccacgttagcaaggacaatgcttctctgccattattacaactagttagtttgcatggagaatctttactttaaaattggaagaaaagtcacaagtgaatggtttataaaaatgctaaagaagtcattcttgcttagaatcatatagaaacatcatgcaatcttttagtcagatgtgcgcttcaccttatgctatttttatctttaattgacacacaataattgtacatgtttatggagtatagtgtggtgttttctgtttgtttgtttgttttttgagacaaggtctcactctgccagtcagggtggagtgcgatggt

SEQ ID NO: 310358 - DNA, 1520 bp, Homo sapiens
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcaggtgagctgaaagacccttctgatatttttttcttacagtctactgggaaaatttaaaaaatagtgctcgagaaatatgacacccattctaagtcttttgtgcttgtgtgcagcattgctgtaatctagtgaggcatcttggacttctggaaaacgcccaggtggtaaagacaatttttggaactcccagctctctattttcagtcttgcttctcaaagtcaccatcacgtctcttctcgtcattccagtatctgtatgctcacttcactgtctctgaataaacagcatttat

SEQ ID NO: 310359 - DNA, 2109 bp, Homo sapiens
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 310360 - DNA, 1395 bp, Homo sapiens
atgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttacaaaaaaaagaaaccgccctccttggccctcagacgttggacgctctggcggcgcctttcctttagtagagggtgagttcctgaatcctcgactgactgactcggtgcggctcggagaataagcttgcgggcaggcggggacagcttcattgagaggcggagaacccggtttatcaaacaatccgggggttacggcaggaaaaaaccg

SEQ ID NO: 310361 - DNA, 1215 bp, Homo sapiens
atgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttaaaaaaaaaaattcggcctcgtggcctca

SEQ ID NO: 310362 - DNA, 667 bp, Homo sapiens
gtcgctatctgtgtcggcctatctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 310363 - DNA, 1547 bp, Homo sapiens
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctgttttccacagaggtagtgaaaagaactggattttcaagttcactttgcaagaggcaagtaggaaggagactgaaagctgctcgtaaatcagtaaatcagttgctttaggccggacacctgccctgtcagtctcagctacatccaaatggaaaaatgggtgatctaggattaccctcaggcgatgccaatggccaaggcactaaaaggtcacatctattattgctggcatttctttccccactgggctgtttttttgagtggatgtcatactcatctcatacagaaggcaggtccatcatgctagagcagtgctgtcaatattagatctaatgaaatacaccctatttttcttttctgcaaacttcattatacctagctgccgctaaaagatgattcctttttttccttactactccaacattacattttagggacatgaatccttaagcaaagtttcattcgccacctctgattttaaagttaaaatgagtcttttaaaaacattaaccaaaataaatggcacagtgagtgccatacccagaagtggctacataaagccactacataaacagtcaat

SEQ ID NO: 310364 - DNA, 876 bp, Homo sapiens
atcccagcccacgcacagacccccaacttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccaccc

SEQ ID NO: 310365 - DNA, 948 bp, Homo sapiens
atcccagcccacgcacagacccccaacttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggtgaggaatctgagggatgtgggtaaaggggagcctcagtcagcccctcacacccctcttctgccctcacaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccaccc

SEQ ID NO: 310366 - DNA, 822 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310367 - DNA, 454 bp, Homo sapiens
cagtcagggatcacacacacacactcatacacgcacacacacacacagctgcctgttctgacggactttctccctaacagaccagtgtatcgacggctgagtgcacagtgagtgtggctgggcggctgcgagggggcttgtgggaggccagggtgcagtgggctgggggtcttgggcctgcctttgctcatccccctgccccccagcactgctgctgtctttattctgctgtccccatctcgggtgcctcccatttccccacccatcaccctcatatccacctctgtccagggtgccgccagctgccgcaccagcccgaacaccattgagggagctgggagaccctccccacagtgccacccatgcagctgctccccaggccaccccgctgatggagccccaccttgtctgctaaataaacatgtgccctcagggccctcaggaactgaatcta

SEQ ID NO: 310368 - DNA, 434 bp, Homo sapiens
cagtcagggatcacacacacacactcatacacgcacacacacacacagctgcctgttctgacggactttctccctaacagaccagtgtatcgacggctgagtgcacagtgagtgtggctgggcggctgcgagggggcttgtgggaggccagggtgcagtgggctgggggtcttgggcctgcctttgctcatccccctgccccccagcactgctgctgtctttattctgctgtccccatctcgggtgcctcccatttccccacccatcaccctcatatccacctctgtccagggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310369 - DNA, 202 bp, Homo sapiens
attactagtgaattcactagtaatcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310370 - DNA, 986 bp, Homo sapiens
gaggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310371 - DNA, 633 bp, Homo sapiens
tggatgactctaccgatcctgaggttccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310372 - DNA, 646 bp, Homo sapiens
gtcctctgctagtctataactataccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310373 - DNA, 842 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagggccctcaggaactgaatcta

SEQ ID NO: 310374 - DNA, 875 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggtactcatggaagcatgcgaccagaggatcgctctagagtcacccgcaggacag

SEQ ID NO: 310375 - DNA, 864 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagggtcaacgatatgtcccgacgaatttaagtgatcagggatatc

SEQ ID NO: 310376 - DNA, 634 bp, Homo sapiens
actctaaggatcccgacgctctctgtgggggatgagctgtcacgggttgggccggactgagagcaacagaaccctgctgctgccctggccccaccttgtccagcacaggaggcccaagcctgggttgtctcccctctcacccacccatctctccctcccaaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310377 - DNA, 1026 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacagtgagtgtggctgggcggctgcgagggggcttgtgggaggccagggtgcagtgggctgggggtcttgggcctgcctttgctcatccccctgccccccagcactgctgctgtctttattctgctgtccccatctcgggtgcctcccatttccccacccatcaccctcatatccacctctgtccagggtgccgccagctgccgcaccagcccgaacaccattgagggagctgggagaccctccccacagtgccacccatgcagctgctccccaggccaccccgctgatggagccccaccttgtctgctaaataaacatgtgccctcagggccctcaggaactgaatcta

SEQ ID NO: 310378 - DNA, 461 bp, Homo sapiens
tgcgcggtcgatctaaggattcctgcaaacggtgggcagcccggcgagttcacgcgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310379 - DNA, 422 bp, Homo sapiens
ccgtcccctttctccgaaaggcacatttgagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310380 - DNA, 480 bp, Homo sapiens
atgaagtcatagctggaatctgagtacttccgttccaggttgctcggcgctaggctgagttcacgctgggcatacatttaagagttaccctgggagtatccgtacgtttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 310381 - DNA, 585 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggtgagggccgacatctcctgggggtgtgagagtcagactgacgtcacaggcaagggatggccaaagctgagggatcctgtcgttcacctcgctgttctgcccggaattcatctgtgttcatccttcctctgttccttagagcaacgtttatagcacatttccatgcagacacacagacagtggtggggatggacatgcacagtcgttagaaaacaagacggagagaggaggggtg

SEQ ID NO: 310382 - DNA, 448 bp, Homo sapiens
tcactcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtgagggccgacatctcctgggggtgtgagagtcagactgacgtcacaggcaagggatggccaaagctgagggatcctgtcgttcacctcgctgttctgcccggaattcatctgtgttcatccttcctctgttccttagagcaacgtttatagcacatttccatgcagacacacagacagtggtggggatggacatgcacagtcgttagaaaacaagacggagagaggaggggtg

SEQ ID NO: 310383 - DNA, 1369 bp, Homo sapiens
  misc_feature (1003)..(1004): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310384 - DNA, 1033 bp, Homo sapiens
  misc_feature (667)..(668): n is a, c, g, or t
atgaagccgcccagttcaatacaaacaagttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310385 - DNA, 1350 bp, Homo sapiens
  misc_feature (984)..(985): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagagctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310386 - DNA, 1286 bp, Homo sapiens
  misc_feature (920)..(921): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310387 - DNA, 1127 bp, Homo sapiens
  misc_feature (48)..(48): n is a, c, g, or t
  misc_feature (54)..(55): n is a, c, g, or t
  misc_feature (761)..(762): n is a, c, g, or t
gtgcttagcaggacccttgcaggagagagaactggtctcgacgtgggngcggcnncgatgaagccggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310388 - DNA, 1313 bp, Homo sapiens
  misc_feature (947)..(948): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310389 - DNA, 963 bp, Homo sapiens
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcattattttttggaccatgttttggaaagtgtaagttcttttaaacattaattttggattttgggaaaaggaaaacacccacccggtggtttat

SEQ ID NO: 310390 - DNA, 1462 bp, Homo sapiens
  misc_feature (1096)..(1097): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaaggatctacctacttctcagtttttgccccagtccgttttgggaatggatcctctcacctaggacaatgagatggttattgttaatacaaacttgcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310391 - DNA, 1337 bp, Homo sapiens
  misc_feature (971)..(972): n is a, c, g, or t
gaaccagtcagcgattagaggccgagtcttcggccacccaaaggcggagtaagaaaccagaagcggatctgattggttgctggaagacgccgcgcccacctcacagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacatagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310392 - DNA, 811 bp, Homo sapiens
  misc_feature (445)..(446): n is a, c, g, or t
caattacaccagtcttctgtatcaacagaagtcttattaaatataaaatgctgtaccctgtcactagttatttaataacatattatttttctgtcatgttccattatagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaaaaaaaaannaaaaaaaaaaaacaaaaaaaaaaaaaaaggggggggggcaaaaaaatttcccggggggggcccaaacccccctttttcttgaaaacagggggcgactcctaaagagaggaggaatattatataaggacaaggggagcggacgcgcgttttaaaaaaacgtgttctgtgagtaggacaaaaatggcttgagtgggcatttctttgaggaaagcacaccatcagttggggagcagggaaaattagtagggacaccactcaccgagaagagtaaatgaaacgcacgcgagggggataaataaacaatggggagtagataatgttgatacaccgagcatcaaatgtgtggagaagaagattaccaagaa

SEQ ID NO: 310393 - DNA, 383 bp, Homo sapiens
gatggagggactcctgacatagccagctgctgtgaaataatggaagagcttacaacctgccttaaaaattaccgaaaaaccttaatacaacagtacgttcttttctccatacactatgtgagaaatgtctcagtcaaaatgatttctggaattatggtagccctattcagttatcacctacttcatagtttgttgtaaggattaaaaggtaataatgcactaggaaagcactggcacaatgtctggtacagggtaagtagtcaaatacgtgctgttattacttttcaagagtagggacaataaatgagtagatttggaaattgttagaacaaggttacaagcttttcttttttatttctttcctttagtcttagacctttagt

SEQ ID NO: 310394 - DNA, 1347 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacac

SEQ ID NO: 310395 - DNA, 1453 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacac

SEQ ID NO: 310396 - DNA, 514 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagtaagaaactttgaataaattcgaaatgaaccaaattgaaatcttgagattg

SEQ ID NO: 310397 - DNA, 466 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagggcagagggtaggagtccagtgctctcggattctgggcactgaagggtggagagcgagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagtaagaaactttgaataaattcgaaatgaaccaaattgaaatcttgagattg

SEQ ID NO: 310398 - DNA, 5417 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccactactacctgtcaggtactgtattatatactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaaacct

SEQ ID NO: 310399 - DNA, 4609 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccactactacctgtcaggtactgtattatatactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgcactccagcctgatgacagagcaagactcagtctcaaaaataaataaaaataataaaacctcaaaaa

SEQ ID NO: 310400 - DNA, 5311 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccactactacctgtcaggtactgtattatatactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaaacct

SEQ ID NO: 310401 - DNA, 5646 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagggcagagggtaggagtccagtgctctcggattctgggcactgaagggtggagagcgaggtaaagtgggaactcggcctggaatttattcccggtctcagagggcggcggtgagaccattttcctgggtcggggctgagaatcctgccctggagccctaacttctgcctcttcagttgcatctgccgctgttctctttaaggcatgcttagtctgtctctatttgtccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccactactacctgtcaggtactgtattatatactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaaacct

SEQ ID NO: 310402 - DNA, 5303 bp, Homo sapiens
atctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcacttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccactactacctgtcaggtactgtattatatactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaaacct

SEQ ID NO: 310403 - DNA, 879 bp, Homo sapiens
tccaattgtcttacttggttattaagtatcgcacactggcaaataatatgtaaggaataagtgacaagaaagttcatgcagattctttatttaaatccaattttagttttttaaaaatagagagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaaacct

SEQ ID NO: 310404 - DNA, 705 bp, Homo sapiens
aggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaactttggtgccacaaaagcaaagtatgtatggtattgccaataatagctaccatctattgagtgctttactacctgtcaggtactgtattatatactccattttaactgtacctcattttgcagatac

SEQ ID NO: 310405 - DNA, 2246 bp, Homo sapiens
ggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccagggtaggcgcgggctccgccaggacactggggacagcacggggaggacatggggcggggaaggggctctcacccaccgccctcctgccggcacgggtggcttcctgcgcgcggtctcagaaggcctggccactttgcattatagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgcccactcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcctgcccgcctgacttctacctgagcatgagacagcccacttccttctaggagggggtggctgactctcttcctgtctgggttggatacactggaataaatgagtcagag

SEQ ID NO: 310406 - DNA, 2136 bp, Homo sapiens
ggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccagggtaggcgcgggctccgccaggacactggggacagcacggggaggacatggggcggggaaggggctctcacccaccgccctcctgccggcacgggtggcttcctgcgcgcggtctcagaaggcctggccactttgcattatagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgcccactcaccagtgcacccaggcttctagggcagcgttgcacggcgccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctcctt

SEQ ID NO: 310407 - DNA, 1501 bp, Homo sapiens
ggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccagggtaggcgcgggctccgccaggacactggggacagcacggggaggacatggggcggggaaggggctctcacccaccgccctcctgccggcacgggtggcttcctgcgcgcggtctcagaaggcctggccactttgcattatagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccatttctgactgaggtattttggagagccagtcttccagctctgagattccttcttcagcttggttgattctgctgataagacttgagactgcactgtgaaattcttctagtgtgttcttcagctttatcagtggcggaggaagaagaaaaatacttctatttgagaaccctattgaggttgcatgccaacttct

SEQ ID NO: 310408 - DNA, 1345 bp, Homo sapiens
ggcagctgcgggcgcacctggaccctcgcaaggcccgggcggcgccgatccccgcgggacgcgctgcgctcggggcctcccgcctccccccctgccccagccgccccccggccgcgcggcgccccgcaccctgcagggacggctgccgcatcgctgggacaaactcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccagggtaggcgcgggctccgccaggacactggggacagcacggggaggacatggggcggggaaggggctctcacccaccgccctcctgccggcacgggtggcttcctgcgcgcggtctcagaaggcctggccactttgcattatagacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagca

SEQ ID NO: 310409 - DNA, 433 bp, Homo sapiens
ggctaccatgcatgtacttggggctgtccagcggcaggtcacttttacgttgcgttgagtgagcttcaaacgcggtttggaccccgtggcttcggcgatttcggaagctcagacaagcatgtgggactgagtcagtctcaatgggtggtggcggcgatgtcttctctccgcagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccaggtgggtccccacgtcggcaccgctggggcggcagcgcagcactcgagcactctccccgagacgctcccagctggaggcccctcgtcacccctcacccttc

SEQ ID NO: 310410 - DNA, 1484 bp, Homo sapiens
aaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgttaccacaaagaacaaagaggtcaatgcgacggcagtgcagtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagctccatgttcctttccatgaagatgccagcactgacacctaagatgtgttctgctagaaaagatagtaagaagcaagcaactttaccaaaatagtgttcacagcatatataatgtcctttagaatatatgtaacaacttgtaatcttttgaaaaaatacaggataaacacttctacaagtggtgtggaaaacatctaaaatattgtcaaaatctgtcaacagtttcatactcatttcagtagaaaagcacatggttctaattgagattattcttatatgcaatgtaaattttatttagttttgttttcttatgcaaattttttctcacaaagcatgtgttcattgttgaatgtcctttgatgcaagttaaatatatgaaacgtactttctgttaccagataatttttaaatttaaatttccttcttaaaattttgtaaataacacagat

SEQ ID NO: 310411 - DNA, 973 bp, Homo sapiens
aaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgttaccacaaagaacaaagaggtcaatgcgacggcagtgcagtggcccagccaagtgggcaccctcacttacgtgtggtggtacggaaacaacacggaggtgggttcaccttccacatgcgatctagggacagaagctcaattcacgctgcctgaagcaaaggagggaatgaaatggcttatgaaccctagagtgtagaagcagttgtagcttcaaggacaacaagctcccttggtgctcaagtatctcatcattatgttctctctctctctctctctggcccctctccaccttctgcatttcatctctgccttcctctatgtttacgtttttctccagctgtacttgtctttgtagtgactcttagcagccctagcttagcagagaaattaaactctatttcctg

SEQ ID NO: 310412 - DNA, 381 bp, Homo sapiens
ttacactaagatgtgcaaatgtctccctaaatgtcactcatgtggagcagagaaagtccaagctatgtgcccaagtatctgtgatccttctctgcttacagggggaagcatgtatcatgggagcaaaaaggatatataagaagcgaaaatcagagcggaagtgtatgcaaggaaaatatgcaggagctatggaatctgaaccctgtgtctgcactgaggctgattttgattggtgagcttgtgcaattatctcctggagccatttggtgtatcaaatccacatgggcctgaatgaaagcttagaattgaaataatagtaacatacatagggctaagtggccagcttcatattcttataaaattacctcatagtttactagc

SEQ ID NO: 310413 - DNA, 1150 bp, Homo sapiens
  misc_feature (434)..(434): n is a, c, g, or t
  misc_feature (446)..(446): n is a, c, g, or t
  misc_feature (449)..(449): n is a, c, g, or t
  misc_feature (463)..(463): n is a, c, g, or t
  misc_feature (471)..(471): n is a, c, g, or t
  misc_feature (493)..(493): n is a, c, g, or t
tcccaggcaacgcgccgcgcggggctccaggttccgcccaggactaactccaggtctgcgcgcgtccaacgagcacggctctcaaccggcctcctggcgcccaacgaccatggcttccaaccggcctccgtgcgcccaacgaccatgactcccaaccggcctccagtttccaactgtttctcgaacagggaagccgccatgacacagctgactacgcccttggtcacaggggacctgagatcctccacgatttacgggaccggcgccacctcgggctcgaaccaccctctcgatagggccgccgctaagtaatcggcgtaggggttcagccgcacatctccttcccgcgccgcggaccgagcagtcgttggtgctcttcaggtgcggcctgggtgcccagagccttcgttagactctcggagccccctgttccnataccgggtagntgnttgtttgggacgangcgccaangcgaggggaattcgcccgaagngggggggggggggggggggggggggggggggggggggggggggggggggggggggggggggggggggggggggggggggactcgctctccctcagccggacctcggccctttttcacaccccaggggagtctggatttctcatagtcctgggcaccagccccttcccagtctagctcttgggactccctgaagccggaactccctcgcctggactcccgggagaacctggaatccccatctccagtccacattttctcagaatctgtcctagcccttcagtctcccaggcatgacatcgtgtggtcccagcgccctaggtggtgagctgtgactctccttagagcctggcgaggccgaggtcctccccagctcgaacccatcccacactccccttctcagcctctgtgttccccagtggtcctggaaaagcccccagttccctctgcctggccccaatcctcacaaacccaattacccacgctcctttccattccataacccccatcactgcatcctccaggctcccatccatggaggacttgaggtggaaagcaatttggttcaaaataaccattatttattacttgaaagggaatatttccagtcgttgccagcctcctccccttctagtattggtaaattttttgcaccactga

SEQ ID NO: 310414 - DNA, 1026 bp, Homo sapiens
tcccaggcaacgcgccgcgcggggctccaggttccgcccaggactaactccaggtctgcgcgcgtccaacgagcacggctctcaaccggcctcctggcgcccaacgaccatggcttccaaccggcctccgtgcgcccaacgaccatgactcccaaccggcctccagtttccaactgtttctcgaacagggaagccgccatgacacagctgactacgcccttggtcacaggggacctgagatcctccacgatttacgggaccggcgccacctcgggctcgaaccaccctctcgatagggccgccgctaagtaatcggcgtaggggttcagccgcacatctccttcccgcgccgcggaccgagcagtcgttggtgctcttcaggtgcggcctgggtgcccagagccttcgttagactctcggacccgcaagggagcccgaactctttcagactcgctctccctcagccggacctcggccctttttcacaccccaggggagtctggatttctcatagtcctgggcaccagccccttcccagtctagctcttgggactccctgaagccggaactccctcgcctggactcccgggagaacctggaatccccatctccagtccacattttctcagaatctgtcctagcccttcagtctcccaggcatgacatcgtgtggtcccagcgccctaggtggtgagctgtgactctccttagagcctggcgaggccgaggtcctccccagctcgaacccatcccacactccccttctcagcctctgtgttccccagtggtcctggaaaagcccccagttccctctgcctggccccaatcctcacaaacccaattacccacgctcctttccattccataacccccatcactgcatcctccaggctcccatccatggaggacttgaggtggaaagcaatttggttcaaaataaccattatttattacttgaaagggaatatttccagtcgttgccagcctcctccccttctagtattggtaaattttttgcaccactga

SEQ ID NO: 310415 - DNA, 6180 bp, Homo sapiens
  misc_feature (647)..(647): n is a, c, g, or t
ctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcacngccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacggaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310416 - DNA, 4269 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310417 - DNA, 5238 bp, Homo sapiens
gcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacggaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310418 - DNA, 4215 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaagatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310419 - DNA, 4283 bp, Homo sapiens
cggcgacctagcaggacccgcaaggttaacaacacagcgaaacgaagaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310420 - DNA, 4325 bp, Homo sapiens
tgcgactctagacgatcccaagtcgagaaactgccagtatcagtgactagaaagtgtaggttgcagtaaacaacacagtcgacgcgaagaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310421 - DNA, 4215 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttatccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310422 - DNA, 2512 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggcc

SEQ ID NO: 310423 - DNA, 2462 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggaagcgtcgcgcatggtaccgagctcgatt

SEQ ID NO: 310424 - DNA, 2457 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcggccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaagagcagaagagggatcccacgaagttatttttatgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaaacgctctctgcaagaggcgtttagcattggagtagggtttagggtgatgtagtgtagg

SEQ ID NO: 310425 - DNA, 1415 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310426 - DNA, 1304 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgaaaaaaaaaaaaaaaaaaaaaaagcggggttttttttgggggcgccacaacgggtaaaaaggcccggccataggttccccccccttttggcaaggggaactcgggggcccaagggggaaaatgaaccgc

SEQ ID NO: 310427 - DNA, 374 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcgtttcgctgtgttgtacacttgcggtaccgagctc

SEQ ID NO: 310428 - DNA, 573 bp, Homo sapiens
cgcgtggactacgacccgtagtgacacacagcgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtacttcggggagatctgatcaaattgttctgtatcatcactgtcgagggagcagcactggatccaggtacctcactccatcctcaccccttcaccatgttgctttctgtaaatgtttctcatatcatccgcactgtgttacacagatgtgggttagggataggattatctatttatcccctaactgcctggcccagtactttgtactcattaagtgtttaataaatacatgttgagtgga

SEQ ID NO: 310429 - DNA, 2218 bp, Homo sapiens
  misc_feature (30)..(30): n is a, c, g, or t
cggggtcgtctagaggatccctcataggtncgcaggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattaaaaaaaaa

SEQ ID NO: 310430 - DNA, 1970 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatca

SEQ ID NO: 310431 - DNA, 2075 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcaaaaacaaaaaacaaaaacaaaaccattcacataataaaatatatccttaacacaaaataagggtataacatattctgcagcatgacattttattttatgtcgacg

SEQ ID NO: 310432 - DNA, 1742 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgca

SEQ ID NO: 310433 - DNA, 4368 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttc

SEQ ID NO: 310434 - DNA, 4023 bp, Homo sapiens
caagcattaaaggaaggagacagtaaattttattaagaatattttgcataacatgtaacattacaaaggagatcatcacgatttacttatagcaggccagaattataggaatttcttcttcaaactggatttgtttctcacatagcctaaggaggtgaaagtctcccttatatatggagtagactgttggaatataagaattctttttcctttcatctgatgttcttttcccttccagatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttc

SEQ ID NO: 310435 - DNA, 344 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaatgtccgcccggaccccggaccacgggtcttctcggccgggtttccaggtcctgtccctgagattgcaggtaccccggccggcagtaa

SEQ ID NO: 310436 - DNA, 4451 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttc

SEQ ID NO: 310437 - DNA, 3144 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaaaaaaaaaaaggggcgcgccagaagaatcccctagggccacactatgcatcaccgcattttgtcacagaggccccaacgagagggataataaaaggcaggagcgagtacaacaactacaggagaaagcaaggtaatttgtatacacaactctggtcgtaattgagccacacaacaccacacacgaaactcactatgtaactcatgtgggcgtgttcagatctcagtagaatagtaaaatacagagataatgaacataacatagacaatcatactcacatccctatga

SEQ ID NO: 310438 - DNA, 1538 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaaaaaaaataagtctgtttgtcatatttaagtagcctgtggctatttttatactgattttgatatcatgttcttttcatag

SEQ ID NO: 310439 - DNA, 4397 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcattttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttc

SEQ ID NO: 310440 - DNA, 1336 bp, Homo sapiens
ggatcttcggagcatgttggcctactgaaagatcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaacaccaaaaaccaggacatggaggcctttcccaaaccattctccagtgagaaactgtgggttgatatggcacgaaaaatcaatgatgcctggcaccctaagggaaactacgtgattaaagcccctgagtctctcatagaagtcggtatacgaagctcatagtgtattattcccagttaccctagaattccccttgacatactgctgtcatatcccaattttacaggacacggctaaaaccgtcttgcaacgtatgagaacaaaaaatacattaacttcgtgttgtgcacaacatgtacgatactacccgtgtagcataattatacagccggacattcgaacatagaactgtccgattacactaagtcggaattgggcgccacggtaagctttaataacacaaataga

SEQ ID NO: 310441 - DNA, 2655 bp, Homo sapiens
tggtgggtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaagacgttggacctctcgaacaaccagctgagcgagatccctgcagagcttgcggactgccccaagctcaaggagatcaatttccgtgggaacaagctgagggacaagcgcctggagaagatggtcagcggctgccagaccagatccatcctggagtacctgcgcgtcggaggccgtggtggcgggaagggcaagggccgtgccgagggctcggagaaggaagagagccggaggaagaggagggagaggaagcagaggcgggaaggtggtgatggggaggagcaggacgtgggagatgccggccggctgctgctcagggtcctgcacgtctctgaaaaccccgtacctctgacagtcagagtgagccccgaggtccgggatgtgcggccctacattgtgggggccgtggtgcgaggcatggacctgcagccagggaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttggagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataaaactacatgcaccatc

SEQ ID NO: 310442 - DNA, 313 bp, Homo sapiens
gcccaggggaaagtctcgtgcgccccgcagtggcagcgacagagcatggcgggccgagagtgactgtcgtgagagtcctgcctgcagcttggggaggaagggaacaggcatcacagccagggctttacaacttaaagctcagcctttatttacattttagttcaagatgggttctttgaaatctcaaatattatgtcagaattagagaaggaagaaagtctgctgattgataggttaagatagttttcctgatggtgattccacaaagtgagtgcctggctggccgggtggagaggagttggaggggagccct

SEQ ID NO: 310443 - DNA, 2926 bp, Homo sapiens
tggtgggtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaagacgttggacctctcgaacaaccagctgagcgagatccctgcagagcttgcggactgccccaagctcaaggagatcaatttccgtgggaacaagctgagggacaagcgcctggagaagatggtcagcggctgccagaccagatccatcctggagtacctgcgcgtcggaggccgtggtggcgggaagggcaagggccgtgccgagggctcggagaaggaagagagccggaggaagaggagggagaggaagcagaggcgggaaggtggtgatggggaggagcaggacgtgggagatgccggccggctgctgctcagggtcctgcacgtctctgaaaaccccgtacctctgacagtcagagtgagccccgaggtccgggatgtgcggccctacattgtgggggccgtggtgcgaggcatggacctgcagccagggaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttggagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataaaactacatgcaccatcaaaaaaaaaaaaaaaaaaaaaaaaaaaaaaaaaaaaaaaaaaaaagggggggcggccgggggggagtcaaaagaaattcgccgggaagctcgggagcaaggagggggattctacggggcggaaaaaaaagagggcgattaacacgagaggcgagcggaagattgagtaacacgagggggcccacaagggtggcccccaggagaaacttctgaggagcggggaaaacaagaagagagagaccacctaggagagatggaaagaagggcatgag

SEQ ID NO: 310444 - DNA, 376 bp, Homo sapiens
tccaggttaaaaaggtattttttatttgcagaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttt

SEQ ID NO: 310445 - DNA, 489 bp, Homo sapiens
tttaagatgtggtcgcgccatgttgcccaggctggagtgaggtggctaatcataggcgcagtcccactactgatcagcaccggagctttttgtcctgctctgtttctgacctgggctggttcactcctctttaggcagcctggtggtcctccactcccaggagctcaccatagtgatgacagacttagcgtagacactccattggcacagcacaccccagccaactcctgggcccatgcagccctcctgtctcagcctcctgagtgctgggaccacaggcacatgccaccacacccagcacagtgtttcttttataattatgcctggaatttgtatttcttcccatacagataccttcacttgctggatggaaatgaaaattacccgtgtcttgtggatgcagacggtgatgtgatttccttcccaccaataaccaacagtgagaagacaaaggtagggtggcatgtgtgtgaacatggtgtgtcttct

SEQ ID NO: 310446 - DNA, 531 bp, Homo sapiens
tttacaacttaaagctcagcctttatttacattttagttcaagatgggttctttgaaatctcaaatattatgtcagaattagagaaggaagaaagtctgctgattgataggttaagatagttttcctgatggtgattccacaaagtgagtgcctggctggccgggtggagaggagttggaggggagccctgtctcggaaaggggcgtggcgtggttgtgaagaccttggaccgggagggtttcctggcacacagcccagccaagggtgaagtgtggacacctcgctgggcttcagggcacaagagaccttgctcatcactgcttctgtgttacagaccaagctccacgaagatctctgtgagaagaggacggctgccacccttgccacccacgagctccgtgccgtcaaagggcccctgctgtactgcgcccggcccccacaggacctcaaggtgctgcagcctcctttgcagggtctgctgaagagtctccttggtgtcgaaagacgccatgctgctactgcagcccgaa

SEQ ID NO: 310447 - DNA, 443 bp, Homo sapiens
tttttttttttggagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgat

SEQ ID NO: 310448 - DNA, 355 bp, Homo sapiens
ctcctgcctgggtggggtgtggggctgagggaggccattggtccagcccctgtcctgtttcctgctgacttttcgccggagtcgtcccttttgctgccagtcaggccccctgctgtggcagtgatgtcctcctctgccttggctggctgggcccgccgtacctccttgctgtcgagtgtcctgggagcatgtctgtgaggcagatcctaacgtatttttcaaatacttctggagacacaagaggggattttggcccattataactggcacatttctgatgctttgggctcttcctgcctcttattttgtatttcgtatttatcttaccttttgtttgtttgtttgttttttgaga

SEQ ID NO: 310449 - DNA, 1739 bp, Homo sapiens
tccctgagacagagtttgctcttgttgcccaggctggagtttaatggcacgatcttggcttaccacaacctctgcctcctgggttcaagcaattctcctgcctcaggctcccaagtagctgggattacaggcatgtgccatcacacccggctaatttttgtatttttagtagagacagggtatctccatgttggtcaggctggtctcgaactcctgacctcaggtgatccgcccacttcagcctcccaaagtgctgggattacaggcgtgagccgtcatgcctggccgagttcagcttttattcacattttttccccgaagtgatttattcttcaaagtagacagttatgttctatagagtgttttgttttttctttaagaaaataatttacataaacagagattatggtaaacattttaaatcttaggctgttggttaaatttaatggtttaagcactgttgggttctctttaattaatatttgcagaaggagaacatatgtgtttcactgatatgtatggtccagaaaaattacttaattctcaaaaatatgttgcattctcatattgtgttagggaaaattccataagtagtctatttttttttttcttttgctgactgttaacatccaaacacctgaatgaaaactgactcatttctgtattggtgtttaaaaatattgatttgcagatgttcacagaacacttgcattttttgattcacattgctaaatcaaatgtaaaggcaaatatgtatatttaataaatgagaagtatttttttattactgaaatttattctcaaagcaaatgtattttgtagatgtttcatttgggagattttgctttgccttaaaacatacaaaataaacctgtcttgtggtctgcccacctcaaaacctctgttaacttgacatgtagaaggagttcagaattctttgataatgtgtggttttcacttttgtttggattaaacaaaaataaaattagagtccatagcactttgtaaactaatgtgaagtttcttgttgaatcataaaagctacctgtatgtactttataatttaatgttctgttagtaaaaattgtcagcattttatctttttctcttctcattacattttagtctccaatctttcccactctcagcagtcacagttttgcagagcaaaacatttttagaaactgaatatgtgtgagttctatataaaatgaatgtgttagtaacatccatctgctgatcaaggaggcattggatctggtactagaaggtgaaattgattgtagctatcaaagcattttatcaatgtaagtcaagaaaaaagaagaaaactgtgaacctctgatatttttaacataaaaactgttcccaatgagtgttctcttgctgattttgtgttaatgttattgtctatgatttttaagctaatgctaatataaaatctaaaatttcaacatgatgacaacaattcctgtagcctgtttttaccattaggatgtttttgaaaacagatgtcatcttagaaattatatttttaagtgcaaataaatcatcctgacttgaaagtcaacacattttatttttcattccgtagtatcacagaatatgctgcatttagatacaggtttaatttgccagattttctcaaaattctgtatttttatattgctacaactggtttacttaacatgcaattgaattgttatttaaataaattacatttgatggaaaaaaaaaaa

SEQ ID NO: 310450 - DNA, 783 bp, Homo sapiens
ttgggcctcctgcagttacgtgaaggtgcttcaggaaggagcatgaggtctgcactgtgctgcttaaccatcttagcttttcatacttacatctccctaatacttggtacaggagaagtgaatgttgcggacagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggtatctgcttttattttcttttcatgtactagaaataaattacctactcacagcagcagggagcatatctaaatttggttatgaagtttagctcatttaaaaaccattgtaggttttgttgtaagttgaacatttctaaataaataattaataaataaaaactgtagcta

SEQ ID NO: 310451 - DNA, 2445 bp, Homo sapiens
ttgggcctcctgcagttacgtgaaggtgcttcaggaaggagcatgaggtctgcactgtgctgcttaaccatcttagcttttcatacttacatctccctaatacttggtacaggagaagtgaatgttgcggacagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcaggttcccaggtgatgctgctgctgctgctggtggtctgtgaagttcactgtgaaaaccacaggtacaaataatgtatgtgttgccatgacctttctctggggctgggctggggttcttcacagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgag

SEQ ID NO: 310452 - DNA, 2323 bp, Homo sapiens
ttgggcctcctgcagttacgtgaaggtgcttcaggaaggagcatgaggtctgcactgtgctgcttaaccatcttagcttttcatacttacatctccctaatacttggtacaggagaagtgaatgttgcggacagagcgtctcctggcacccttcctccagcagtttccaaatggctcactcgtgttgttttatcatgcccgaatagagttgctgaaagggaatcttgaagaggcacaagaagtatttcaaaaatgcatttcagttcaagaagaatggaaacagtttcaccatctctgctactgggagctaatgtggattaatgttttccaacaaaactggatgcaggcatattactattcagatctgctttgcaaagagagtaaatggtccaaggcaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtgaataagagacaaaaaaacagtttttttggtcaatattttctatcatctgagagatttactgttggtctacataattttttttcctatggaatggcattctatattatctagaaaattcttatattttgcctcccccaaaagaatttcatattatttgaattagggggcgaagaagtcttttgaaagacttgcagatgcaatagtctaattagattatttatttttttaatgtgaaaattaatattgtttagcaaatagcttacaagttgagccaattttggatttgttgggtagttaaacttcagagatattttgttgcctgtatttaaatttcagaagataaataaatatcattgcatttaaaatagcttaacagtgaccttcagaagacttctgaaaaagacagtctgagaacatgaacacggatcgatataatgtacttcatgggttgaagagacctttctctataaaggatgatgcagtattcagttagtggttttttactcttcatttgattaaaggtggtgacgttttggagagactgattttgaatgtacttaagtctattataataacaaaattcaaaacccctgtgtatctaaagggaaggaagtgtcatattttaggaatttttcttaaccttagcaatgagagcctaaaatacatacatggattatttttcttctaggaagtaaatttcctgctgctttaaatgatatgtaaaatatcaataatttttacacttaagatgttggtaagacctagttttctaatctctctagcactgtgatgtctccttgtagataatctggaccttgcttagtcctttagttgggaaacagaatcagggcatagagcagaagagagcttgacactccatatggtcctggttctgctacccattagcgattagtgaggagacctttagggagtccactgtgccctgtgtgtcaccacattttcttctgtgaaatcaagattaaagaacagatgactttcaaggtctttttcagttttataactgtgagtctatgtattaggtatttattttcaacaaatgactttaaaatgtcgaatgcaaaccattcccacttggagtgttttatttttcaatcatcatcattgcccccaactccccacatgtatgtgttgtggcatccagagtgagaaaagacaatttatgag

SEQ ID NO: 310453 - DNA, 694 bp, Homo sapiens
ttccagtgccctgatgcccaggcttttcatgataatgaaaattaattctgatccacttatgagaagttggagggcaatgagataattttttcttgttcattctgtccactttctcacctatgaatgctgtagttgtataataggaaaatggtttaaattatgggtaattgaaaagagttgttgtcattttgaacagggaatataagatttcatttcctctgatttctttaatgcctctaattttatatctggaagacttgttggtcattcctgatttgaaaggtagaaatgtcatttacctagggatgttctgtaataagctccttctttttctcaaggcaacttatgtgttcttgaaagcagcaattttgagtatgcttccagaggaggatgtagtagcaacgaatgagaatgtggtaactttattcaggtatgtgagacactattcctataacaaaggctctgagggtataaaggggcaaaatctcatctctactgaaaatacaaaaaattagctgggcctggtggcatgtgcttgtagtcccagctacttgggaagcttaggtgggaggattgcttaagcctgggaggtggaggttgcaagtgagctgaaataatgccattgcactgcagcctgggtgacagacagagtgagactctgtctccaaaaaaaaaccatgtatattaactgtag

SEQ ID NO: 310454 - DNA, 3327 bp, Homo sapiens
taaatctagcttgccactctgtgccttttaagtggggcatttgcccatttacattcaaggctagtatcgatttgtgtagatttgatcttgtcattgtgctgttggctggttattatgttggcttttttgtgtggttgctttatagtgtcaccggtctgtgtgtttaagtatgtttttgcattagcgtgtagtggtctttcctttctatatttagtcctcctttctaaaatctcttgtaaggcagatgtggtggtaatgaattacctcagaatttgcttgtctgtaaatgatctcatttctccttcatttagaaagcttagtttagctgtatatgaaattcttggttgaagattttctttaataatgttaaatatagtcccccaatcccttctggcttgtaggatttcagctgagagatctgctgttagcctaatggggttccctttgtagatggcctgccctttctctctggctgcctttaacatattttccctcatttcgaccttggaaaacctgatgtttatgtgtcttgaggatggtcttgtgtagaatcttgtaggagttctttgtatctcctgaatttgactgttggcctttctagcaaggttagggaagctttcaaagatgatatcctgaactacgttttccaagttgtttgatttctccacctccctttcagagatgccagtgatttgtagaattggcctctttatataatcccatcctccttgaaggttttgttcattcttttttatttttgtccatcttattttagagaaccaatcttcaagttctgagattcgttcctcagatttttttttctgctgttaatacttgtgattgcattgtggaattcttgtattgtgttcttcggcgctttcagatcggttaggttcttttttattataccagctactttatccttcagctcctgtaacactttactgttattcttattttcctcggattgggttttgccattctcctgagtcttgatgattttttttcctatccatattctgaattatatttatgtaattccagacagttcatccaggttaagaactcttgttggagaactggtgtggttgttagaaggacatatgacacagaggccatttgagttactggagttcttgcattggtttcttctcatttccacctatgggttttcctttaattgcagtgtagattgagtacagtccgtagacttattttcggatgttttcaccaggctgaggctttgtgcagggtctttatttgaagctgacttctcatttctggtttcagaggggagtatattagtaaggtatttttgatgctgaagctttgggatgtgatccagtaggtggcacttgggcttactggtcagttggtagactcttgcttggtcatgtggctcccctatgtttccttacagttgcagccatgttccctctcaatgatctgaaaatgtgcttctctcccccttgagtgctggctgtaggtcatggcttggcactcctaggctgcccactgcagctctggggcaatctcagtgtttatatttctttcctaactttgaggcagaagaggaagggacattagtagtggttgtagccaagggtcttttgtttgtctcctcagagttccaccacccctggagaatacagcaactgtttactgcaatcagcaatcaggatggagaattcgtgctgtgggggccaatccaggggttccctgtcatgagcagtggggagtgtgtagaacccatgagagatgggctttggtcaattaaagcttgttgaaggtgtagataagggtgttagctccttcatcagtctgagggtagcaaggacagttccactgcagaagcagtggcagagaggctttcagttgcccctggaggctctctccagggagtggctgagttgctactggctcaacagttctggtagggggggttaggtagaggtccaggcctgcaagacttgcctagtgagaagatataggaatgggaacccaggtaacagtctggccacttttccatagggctgctgcagtatgcccagggcccgctccagtctctagtagcctcagattttccagtacctggagttatcatcagtgaagcctgtgaaacagcaaagatggcagcctaccgctccctttggaagctttgccctagggaggtatgaatgaacttgttgctggcccaaacacacctgtaggaggtggctggagaccccagtttggaggttttgcccagtgaggaggaatggcattgggaaagtgcttaaaaacgcagtctggcctcatttttatagagcagctgtggtatgctgagggtccacatcaccccctggtctccttggacactccaaagactgaaggttgaagtggctaagttgcaaaaacagcaaagatggtggcctgcccctccatcagggagctccagcccagaaaaaattgaaatcactgtcagcaggagaacaccagtgggggtggttggaggccccagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310455 - DNA, 927 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaagggttcctgttgggataaaacaaaattggggtaaatcaacccaaaaacgaacttgaaaaatggctaaaaattccttaattgcaaaatacccgggcatggcatacagaccaacctcaccgacattggagacgccgcgtcacaagttgaactctccccccaacgtcgcacaaccacacgcg

SEQ ID NO: 310456 - DNA, 707 bp, Homo sapiens
acggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcgtttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310457 - DNA, 903 bp, Homo sapiens
ggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttggcattttgcagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcatttattttttatttttctcaacacgctctttggcgcttgtgggacaggtttatagacccacaatttttcggcggggggagaccactttcttttacaaagggtg

SEQ ID NO: 310458 - DNA, 1162 bp, Homo sapiens
gtggcacgacttcggctgactgcaacctctgcctcccgggttcaagcgattctcttgcctcagcctcccaagtagcagggactacagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggtttgcacatgtgcaaccgaacgtggatggaaaatgcagtatttgcaggatttgaaacccatgtatatagtgggccaacttttcaaatctgctggttccagtcagcctggaacttaagtatgtggggattttggtgtatgtgggcgtcttggaaccagtccccttcgtatactgggggatgactagttttttttagaaaagaattaaaaaaaatttctttaacaaataattatgtatgtttatagggcaagaggatctagttcttaaagagtgataaatgagacataataagtactgctttcttagtagtacatttttgtttagagtgaagttttccagatcatcttcacattatatttacttcacaaaatggcctgtcaaaaagtataggcattcttatatagagaagga

SEQ ID NO: 310459 - DNA, 991 bp, Homo sapiens
  misc_feature (19)..(19): n is a, c, g, or t
aggggttttacaaggttgnaataaaggtttcaaagaattatcttaagtgatctaacttccttaatctaaaaaaaaatagtattaaatattataaaaaaaataaataaagtaaaaatgttctcaatctaatagaatatttaagtaaaaattaggggatttttctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcata

SEQ ID NO: 310460 - DNA, 916 bp, Homo sapiens
gtgccgctttgatgatgttgtccacacgcagaatcacctctgctgcttcagctgcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattaaaaaaaaaaaaggagaaaaaaaaaaaaaaaaaaaaaaaaaaaaaaaaaaaaaaaaaaaaaaaaaaaaaaaaaaggggggggggccgccacaaaaatcccccccgggggggccaccaatacaagcaccccccaccaccatcgtctttagtaaacaaagggggcacccacataaggagggcagcatataataaacaccaccgcacacaggacgccgcgggcataaaaaacaagaagcactgggacaaaaccgcggcgacaccggcgagaactcttctgggacgaggcaacaccacaaacatacgaggcgggcggagcaccacacaataagtcgaagacccagccgcacgcagcaaaaggtattaaaacagaccgccaaaggagcgggaagaatactaaacaaactgccgcgccgcacgagacaacaggcgcgcaacaacccccccacagcacaatacacctacgccgccccgccgcatcaagacaacttgtcagcggccacacacaagcgacagagacatttacccagaaggagaatattatatatccaccgggagcgcgcagaacaccaatcaaacccgg

SEQ ID NO: 310461 - DNA, 616 bp, Homo sapiens
ggatgttgttactgtgatttttttgtgtaatgtcctgagggccattaagcctttaaaatgtggcacagctctcaccagccttgtgtttatctctgctcttgcaggactgtcatagcccagattctcaaccatccctgatcccctacaatgagttctctagttgtgttttgcttccaaaattattctactggacatgcctgcatccaatgccaattgacttaatcaacattgtccatttgtgtgttgcattctgatctcacctcgtgccgaattcggcacgagcctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaagggagcaattaattatattatcctgacagtttttgggctgctgtgtatggctattgacatgcatatttgcagggtggaacccctactctggcacaagtgtgaa

SEQ ID NO: 310462 - DNA, 506 bp, Homo sapiens
tgtttctttttttttgcggtaaaacccccacctgcagaggctgtgactggccccagagactatacgctattggctgctgcgggtctgggcgggcctggagccagaaggcgacttatgatgtctctcctatgccaccccaggggggcagggacattgtagacttggaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaaggcacgcagacttttaattgccgattccaccccaggccatcatgcgggttggagagccccaccaagcttgcagcgagcccctgtagtcctcccccccccatcgtcccacggtccctctcgtcattg

SEQ ID NO: 310463 - DNA, 153 bp, Homo sapiens
ttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaa

SEQ ID NO: 310464 - DNA, 1953 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310465 - DNA, 2532 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattaaaaaaaaaaaaggagaaaaaaaaaaaaaaaaaaaaaaaaaaaaaaaaaaaaaaaaaaaaaaaaaaaaaaaaaaggggggggggccgccacaaaaatcccccccgggggggccaccaatacaagcaccccccaccaccatcgtctttagtaaacaaagggggcacccacataaggagggcagcatataataaacaccaccgcacacaggacgccgcgggcataaaaaacaagaagcactgggacaaaaccgcggcgacaccggcgagaactcttctgggacgaggcaacaccacaaacatacgaggcgggcggagcaccacacaataagtcgaagacccagccgcacgcagcaaaaggtattaaaacagaccgccaaaggagcgggaagaatactaaacaaactgccgcgccgcacgagacaacaggcgcgcaacaacccccccacagcacaatacacctacgccgccccgccgcatcaagacaacttgtcagcggccacacacaagcgacagagacatttacccagaaggagaatattatatatccaccgggagcgcgcagaacaccaatcaaacccgg

SEQ ID NO: 310466 - DNA, 2195 bp, Homo sapiens
ggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310467 - DNA, 2212 bp, Homo sapiens
cgaagtagggcgtgtggcgtcacttccggcttccttcagtccgctggtcccgagcacgagctgtgaggggattcacttgtgtgcggaactcctcggaaccatggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310468 - DNA, 2241 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcata

SEQ ID NO: 310469 - DNA, 1772 bp, Homo sapiens
ggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttggcattttgcagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310470 - DNA, 1495 bp, Homo sapiens
acggtgatctgcgtgtggacaacatcatcaaagcggcacccaggaaacgtgtccctgatcacctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310471 - DNA, 1254 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310472 - DNA, 1183 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctc

SEQ ID NO: 310473 - DNA, 1621 bp, Homo sapiens
cgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggtttgcacatgtgcaaccgaacgtggatggaaaatgcagtatttgcaggatttgaaacccatgtatatagtgggccaacttttcaaatctgctggttccagtcagcctggaacttaagtatgtggggattttggtgtatgtgggcgtcttggaaccagtccccttcgtatactgggggatgactagttttttttagaaaagaattaaaaaaaatttctttaacaaataattatgtatgtttatagggcaagaggatctagttcttaaagagtgataaatgagacataataagtactgctttcttagtagtacatttttgtttagagtgaagttttccagatcatcttcacattatatttacttcacaaaatggcctgtcaaaaagtataggcattcttatatagagaagga

SEQ ID NO: 310474 - DNA, 948 bp, Homo sapiens
gtaactcttttcactaagctttttttttcttttggaacataaagagttacaataaccgtataaaagactcttttggactttgtcctcataatcattacatgtgctgggaaaatgtgtgtgactttatatgctcagcatttcccaaactttgttattccataagacatgtaaaactggttagaagatttgtaactatttggtatataacgactataggatttaaatgtaaacaatacttacattctgaaaaataacataaactattatgttgtttatacaatcagtattaacttctaatttcatagtaaacttactgcaagataatcttgagtacagatcacagatctctagtccatagataaaagtggccaatgaggcagatttaattcatattgaaaaactttctgacaagctgtgctggacattatagagtagtcttaagaaggtagataatcctgtcattgaacaagagggagcaccagttaatctgtgagaaaatgaagcaggattctcacaagaagagaagttggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310475 - DNA, 653 bp, Homo sapiens
acggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcgtttgtaggcttatctacctactgagtaaagtagttgggtgtcctaattttattaataggattaatttttattataaatcattagagatgttttgatactttagttttggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310476 - DNA, 1383 bp, Homo sapiens
  misc_feature (1015)..(1015): n is a, c, g, or t
  misc_feature (1017)..(1017): n is a, c, g, or t
  misc_feature (1021)..(1021): n is a, c, g, or t
  misc_feature (1170)..(1170): n is a, c, g, or t
  misc_feature (1383)..(1383): n is a, c, g, or t
ggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaagggttcctgttgggataaaactggngnaaancaccccaccgtcttccactgctccccaccctcgtttgcgccactcgcggctggtccccgcgccccaaacgcatctcgtggtccccggcgaggaagatgactcctcaacccaacgggtggcgacaacaacagtgggcgacggcaatcagntgatggagacgcaaacgacagtcatgtccagcaaacagatttttatagcacgcgagaattatcccacacacagtagcgttggtgtcgcatgcccaccaatgcatggcaaccacatcgcagtaagatagtaccacacagcacgtagccgcagactaatacctatatgcatgtgctgctatctttatctctacttctttattccatcctgctcgn

SEQ ID NO: 310477 - DNA, 905 bp, Homo sapiens
taagctaccaagggtgaaaagtttatctctctatatgatccctgtataatgctgtactctttgatctgttcttaagcttcttcagcttctcgtaactgttgtgtttgcctctaaaagcagtgtttctcaagctttagatccttgaacaagcattaagtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310478 - DNA, 844 bp, Homo sapiens
atgtgagtcttatagtgcacacacatgcaaaccattgcagacttataacagtcttaatacacgattctacttgtgtttgtaaacactataacacttaggatcaatcatgctcactcagttctcactacccacttcgttcctactctcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 310479 - DNA, 250 bp, Homo sapiens
aaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctctt

SEQ ID NO: 310480 - DNA, 313 bp, Homo sapiens
tttttttttgttgttgttgttgttgttgagagggagtctagctctgttgccaggctggagtgcagtggtgccatctcaacttactgcaacctccacctcccgggttcaagtgattctcctgcctcagcctcctgagtagctgggattacaggaacacaccaccacacccagctaatatttgaatttttagtatagatggggtttcgccttgttggccaggatggtctcaatctcctgagcttgtgatctgcccgcctcctctctttactcttaattttagcttgaaactcccctgttgccatttttcaccagg

SEQ ID NO: 310481 - DNA, 2733 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310482 - DNA, 2748 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaaggtttggtccttgtttttcaaggtggctgggatgagcccttgggcgcctcaggtgcctgtatcacccactcctccctaccaaagagggcatcttcctacaggaggacaccttgctgtatgtcatttcccatgtctcttgcaagaagctcagttccatttgcagactcaggtctttcttcaagtcagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310483 - DNA, 2731 bp, Homo sapiens
  misc_feature (329)..(329): n is a, c, g, or t
ttctatgtcgatgcttgtggttaatctggacgagtcccacctgggctcgctccgagtcggcctgtctgtcgggcccgccctccccgctcactccctccgccctcgtgctcctcccggggtgcttggcacagcctcggattcctccctctcgctgctcgagtcagtttccctatctgtgctgtgcatgctgtggcaatggctggctgtgctgtgctgtgctgtgctgtgcatgcctgctgtgttgtgctgtgctgttggtgtgacacatctctgtgcatgccagcctgctgcgttctccctgtctgtgatgctgtgtgctgtccatgctntgtgcttgccctctgtgatccttcccttgccactgtttctgtgtgtctgcccttgcaccctcccagcccatgtgctctgctatcttcttctgagctgctggtgacatgtgtgctgccttgcatgtgatcctgcctgccccgtccaagcctgtgatccttgtggtctagatgctccccagaggctgatgtgctgctctgccaattgaactccctggcccctgccaagcccttgacctgcctgtggtgtgtgtgccccccgtgtgacgttagctgcctgctggatgatgtgaatgctggcaatgggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310484 - DNA, 2855 bp, Homo sapiens
  misc_feature (815)..(815): n is a, c, g, or t
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagttaggtacctatagttttctcaatggctgtgcatggtcatgagccncttggcgcgcctctaggctgcgcttgtatcacgctcacgtccttccctaccaatatgagggctatcttcctacgagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310485 - DNA, 2634 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310486 - DNA, 2162 bp, Homo sapiens
gtacggcaagtagaggcccggttaatcggccgaggggatcacggtgctgctgttcttctgggtaaccaagaggaagttggaggtgccgacgggacctgaagtgcagacccctaagggttcttcccaaagttagtgcagcctacacccaggattgaacaaagacagcttggaagttagaagcaagatggagtctgttagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310487 - DNA, 2504 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaagtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310488 - DNA, 2767 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagtggactctcctctctccctgtgactctcctccagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctgga

SEQ ID NO: 310489 - DNA, 2802 bp, Homo sapiens
  misc_feature (2802)..(2802): n is a, c, g, or t
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctggaaaaaaataatcggtcctcgttggcttagaggaagaagctctgacagccccttcatttaataaaggatan

SEQ ID NO: 310490 - DNA, 2446 bp, Homo sapiens
ggcatcccgagtgcaccgctcccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctgggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagtgtattaaaccgcacccctacgcatctgatccgggaaatcatattagtggatgacttcagcaatgaccctgatgactgtaaacagctcatcaaattgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtc

SEQ ID NO: 310491 - DNA, 321 bp, Homo sapiens
ccaggcccaggccccttcatggggtggatggagatttccatggagatatgacctccgagtctctggcacttgagtagcattttccaaggtaaccttgatgatcattgcctactgggacccttggtgcttcttaccagcctgtgctaatcacacccgtaagtgtggttgtatcccacgagtggtggcttcctggatcctgaacaaaccttcctggtctctttctccccaggtatgggccttcacatacacccagcagatcctccaggaggagctgtgcctgtcagtcatcaccttgttccctggcgccccagtggttcttgt

SEQ ID NO: 310492 - DNA, 1672 bp, Homo sapiens
cccaactggcagcgacacgtagggacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagacagccttccccaggtacgactccgccatgagcatcatgaccgagatcggaaaccgcctggggcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggaaaaaaaa

SEQ ID NO: 310493 - DNA, 1495 bp, Homo sapiens
cccaactggcagcgacacgtagggacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggaaaaaaaa

SEQ ID NO: 310494 - DNA, 1507 bp, Homo sapiens
cccaactggcagcgacacgtagggacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggaggtgaggtcaccgggatgcaggggctgggggcagggggcaggggcacaggcctgatacagcctgattccatcccccacctggctctgcagacagccttccccaggtacgactccgccatgagcatcatgaccgagatcggaaaccgcctggggcaggtgcaggcgctgctgggtgtggccaagtgctgggtggccaggaaggcgctggacaaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggaaaaaaaa

SEQ ID NO: 310495 - DNA, 659 bp, Homo sapiens
ggcactccagtggtggtggcagaggagtaggcctgagccactggcctccctcgcaggagtctatgaagatcgcgctgcagcacggggaccggccactgcaggcgctctgcctgctctgcttcgctgacatccaccggagccgtggggacctggaggtgaggtcaccgggatgcaggggctgggggcagggggcaggggcacaggcctgatacagcctgattccatcccccacctggctctgcagacagccttccccaggtacgactccgccatgagcatcatgaccgagatcggaaaccgcctggggcaggtgcaggcgctgctgggtgtggccaagtgctgggtggccaggaaggcgctggacaaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggaaaaaaaa

SEQ ID NO: 310496 - DNA, 475 bp, Homo sapiens
tccctgtgagcaaggcctgtcagacagctctgcccgcagccctggcctatgctcaccttccaggctctggatgccatcgagagagcccaggatctggccgaggaggtggggaacaaggtcagacttgattctgtgtcctggatctggggtcaagggcccaagtggggaacttgggtctggggaagggccttcctgagcctactcacgtcatgagcccttcctgatgctgggagctgcctgcagccaaccccatactctggctctttctctgccacacacacagcacttctgagggcagggcagaagtttcatagcttggaggatagcagaattcctcagaagcttcctgatgttgattaaaacccctaacagtgggctggacatggtggctcacatctataatcctagaattttgggaggccgaggtaggaggatcacttgagcccagaagttcgagagcagcctgggctacata

SEQ ID NO: 310497 - DNA, 827 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310498 - DNA, 806 bp, Homo sapiens
gcaaccactgcagctgggcctagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310499 - DNA, 1156 bp, Homo sapiens
  misc_feature (1156)..(1156): n is a, c, g, or t
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaccacaacaaaacacaaaaaacccacacacaaaccatacccttccaaaataaaaaaactcgagggggggccccgttcccaattcgccctataggggagcgggatacaattacactgccggtcgttttacaacgccggaattggtggttgcggattaacgaataaggcccgcaccgatcccccn

SEQ ID NO: 310500 - DNA, 764 bp, Homo sapiens
tcagtatgccagatcttactgtgattactggatgtaagtgaccttctaaccttaaggctgcgaatataagattagattctgttttcaccaaaatccaggaatagacaaaaagactgatacctggtatctgtacctcattgagtgaaaggagttaattaagttcctcaggggaactccggagattcagggtgtcttgttagttgtaggatgccttcagtagcttacaaacaaaaccataaccttcctggaacccagcactctggaaggccaaggtgggaggattgcttgagtccaggagttcgagaccagcctgggcaacatagcaagacctcatctctattttttatcaaaaaaaaacaaaaaacaaaaaacccatagccttggccttttgtcgctgctttcataatttggaaggcttctgttttattgagtatacgaagctagcattcttctaacttaatcttttctgtttgcaggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310501 - DNA, 344 bp, Homo sapiens
taaattcgcggccgcgtcgaccaatgaggtgctgaaacagtgccgacttcgaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310502 - DNA, 339 bp, Homo sapiens
gcccgcagtgtgcctggattctcattgttgagcagtgccgacttgctaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310503 - DNA, 642 bp, Homo sapiens
  misc_feature (128)..(128): n is a, c, g, or t
aggcgaagggggccttccgcgtattcgatgtttgaacgcctgcagactatgttcggactccccttcggcaagtcgaagggggttcgattggtctcgagctaatgctggagataacatcactattatgnccaacgggtcatgtatgccaggagtaactcagaggtgttcttgatcgttgtcgataaagggtcggagaggttcaaaggagccacttattagtaactagtctgatagtagaatgatggctagggtgacttcataatgagatctctcttgggctactgctccgcagtgcgccgatcagggcgtagctttgacgtttgatgctcaccctgatcagaggattgagtaaacgcgctaggtctagaggtggcctagaataaataggaggcctaggattgaggttgaccagggggttgggtatggggaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310504 - DNA, 217 bp, Homo sapiens
gcggccgcctactactactaaattcgcggccgcgtcgaccagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310505 - DNA, 824 bp, Homo sapiens
aaacttaggctaggtagcgaggcctgggtgtcgctcagtagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310506 - DNA, 1515 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaaaccattcttaatatatgcagttcccctgaa

SEQ ID NO: 310507 - DNA, 1129 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaacaaaaaaaacctcgagactagttctctctctcaactcgggggggtggagaagccttgagcaggcaaagtctctcgggaacccccctgtacgaggcggggcgggaagccctgcggggaacccgcggccaagcccgcaaggtccctggaaccgg

SEQ ID NO: 310508 - DNA, 1069 bp, Homo sapiens
  misc_feature (986)..(987): n is a, c, g, or t
  misc_feature (993)..(993): n is a, c, g, or t
  misc_feature (996)..(996): n is a, c, g, or t
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccacggaaaaaaaaaaaaaagggggggnnaaaatnccnggggcaagttcgcgacccttttgtaaagggccaaagaggcgaaaaaagggcgggtaagggggaacgggctcgg

SEQ ID NO: 310509 - DNA, 1698 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaagaacgagagagagggaacggagaaggaagaggaagacaaggaaggaggaggaccacagcggagcgagcgcgggaggggcggcagagaagggggggggggaggagggggagagaaggggagcgagcggcgagcgcgcgcggccgacgcgggagggagggacagcgagtgagcgaggaccaggacggaagagcgagagcggacaggcggggcggggggccgcggcgccggcaggacggcggcgcaggagagggggggggagcgagagcaaaggcccggcagcggcacggaagaagcggcagacaggggagagggagcgagaagaggacgggaggagcagcggagaacagagacgaggggccggagcgcgacaggggcgggtggagaggaaacaggagaggagcggggaacgggagcggagcgcagcagtaacgcagtcgggacggagcggaggggaccacgaccgcgtgagcacgacgcggaagtggcacgaccgaagaagggcgcagggacaggcgcacggcggcgggcccgagcgggggagaccggcggcggacgggcacggggaagcggaacgacgagaggcagaagagaaagaggaggcgaagcgagaagggaggagagagcagggggagacggaaggggccgg

SEQ ID NO: 310510 - DNA, 943 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctggggcactgtttggactctgggcactgtttggactctg

SEQ ID NO: 310511 - DNA, 786 bp, Homo sapiens
cgactcttgaggatccaccgacacgccgaagctccaaccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310512 - DNA, 823 bp, Homo sapiens
gtcttttacttccttagttaaatttatttctaggtttttaattgttttggtagctattgtaaatgggattgtgatatagttcagatatttgtcccctccaaagctcatgttgaaatgttatcccgcatggcccctcgtccccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310513 - DNA, 1001 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggaggtggctgtgtgcgttatctccctgtggcatgccaggaggcgtgtgtgtgcgcacgagtgtgtgtgtgcaagcatgtgcatgtgtgtctttgtgtgtgtgcatagtatttgtggtgtgttgaatcaactacg

SEQ ID NO: 310514 - DNA, 770 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310515 - DNA, 664 bp, Homo sapiens
tgtaagcgacggggtttcaccattttgcccaggctgatcttaatgtcctgacctcaacccaccttggcctcccaaagtgctgggactacaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310516 - DNA, 834 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310517 - DNA, 1507 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaagaacgagagagagggaacggagaaggaagaggaagacaaggaaggaggaggaccacagcggagcgagcgcgggaggggcggcagagaagggggggggggaggagggggagagaaggggagcgagcggcgagcgcgcgcggccgacgcgggagggagggacagcgagtgagcgaggaccaggacggaagagcgagagcggacaggcggggcggggggccgcggcgccggcaggacggcggcgcaggagagggggggggagcgagagcaaaggcccggcagcggcacggaagaagcggcagacaggggagagggagcgagaagaggacgggaggagcagcggagaacagagacgaggggccggagcgcgacaggggcgggtggagaggaaacaggagaggagcggggaacgggagcggagcgcagcagtaacgcagtcgggacggagcggaggggaccacgaccgcgtgagcacgacgcggaagtggcacgaccgaagaagggcgcagggacaggcgcacggcggcgggcccgagcgggggagaccggcggcggacgggcacggggaagcggaacgacgagaggcagaagagaaagaggaggcgaagcgagaagggaggagagagcagggggagacggaaggggccgg

SEQ ID NO: 310518 - DNA, 582 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccagagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310519 - DNA, 757 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310520 - DNA, 835 bp, Homo sapiens
  misc_feature (14)..(15): n is a, c, g, or t
  misc_feature (610)..(610): n is a, c, g, or t
  misc_feature (614)..(614): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccagccgggcccctcagatgagagctgcacccagagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaacaaaaaaaaaanaaanaaacaaaaaagagaggaagaacaccaaaacaagaagaacaacacgagaaagaaccgacaaaagaaaaagaagaacgaaacaaaaaaaaaggagagagaagaggggcgggcgccaacaacgaagcatcgataaacgacggagactaaagaagaggcggggggccccacaaaaaaggcgggccgaagcgcgagtggctcacaaggagaggccggagcgctact

SEQ ID NO: 310521 - DNA, 919 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaaggtcggctgcggcgtgggctcgcctctgccaggcgggggtagattgaacgtaaagcctatgttaggggagtgtggggagggaattcacttacggaaaaagcttcctatccaaacaacgggaaaggcataacgttatggccaggtggcaggaaggcataaattttgacctagcttgatttcggggaaaagagcacccaaggaaataatccggaaatggtcagagggagcgtgatacatatgaagatttttaaatacgtgcaggacataattagtcttttgttatttgagaaggggtctcgaaattgttgaaagcatctgaacgttgaacagatgaggaatagttgaagttgcttttggtataatagttcagacgagtcactttggccagtcttgttttgtaatgtgtaaaatgaaggaattggactagattatttccccagttgaccatctttaagtcctaattagaatgtttatctatttatattttgagtcagagtctaactcaggctgtagtgcagtgacgtaattatggctaactgcagccttgacttcctgggctcaagctattctaccacgtcagcctccagagtaactgggactacaggcatgcgccacctgtgcaccacacttggcgactttattctattttatattttagcagagacagggtctcattatgtg

SEQ ID NO: 310522 - DNA, 335 bp, Homo sapiens
ttctttctcagcaatgttgaatgttttgcctttgcaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggtaggtaatttgtccaatttacatctgcttaattcacagtggaattcctggatcctgtagaacttagggtaatctgtgtttaataaattagagaagactttgttgaaatttctctagaattaactcctaacaactgggccggaggtttctagt

SEQ ID NO: 310523 - DNA, 961 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310524 - DNA, 1102 bp, Homo sapiens
  misc_feature (936)..(936): n is a, c, g, or t
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgaatctgtggagtatagataagcattcttcnaaaaaaaaaaaaagcggggtttaggtgggcggggaaagggttggaaggcaggcatagggtcggccggtttgaaggagatggggccaaggggataataagagtgagatatgaagaaggtgagagtatggggagagggagggagaaatgaaaagttgagagaagagaa

SEQ ID NO: 310525 - DNA, 1649 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaaaccattcttaatatatgcagttcccctgaa

SEQ ID NO: 310526 - DNA, 1214 bp, Homo sapiens
  misc_feature (989)..(989): n is a, c, g, or t
  misc_feature (993)..(993): n is a, c, g, or t
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaacaaaaaaaaaanaaanaaacaaaaaagagaggaagaacaccaaaacaagaagaacaacacgagaaagaaccgacaaaagaaaaagaagaacgaaacaaaaaaaaaggagagagaagaggggcgggcgccaacaacgaagcatcgataaacgacggagactaaagaagaggcggggggccccacaaaaaaggcgggccgaagcgcgagtggctcacaaggagaggccggagcgctact

SEQ ID NO: 310527 - DNA, 1379 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaaaaaaaaaaaaaaaaaaaaaaaaattggggggggggtgagcggcctctgagaaaagcgttgttcataacaccaatctccggtggggcgcgcggcgggcgccaagtgaaggggatagagggaggaccatgggcgccaataagcgcgtggtccactataggagaaagactcgggggccaaaggagagaaagggggcggggggatttttctaacaaaatataaaaaaaagcggcgcggggggggacaacgagaggcgcgtttcttggagaacaatatctctcaaagagagggagagttctcggaggggggtaatataaggggggggagttcataattaaagcgggggagggtccaaagggagaggcttgagaaatattaataatttaagcgcccgcggtctggtgc

SEQ ID NO: 310528 - DNA, 781 bp, Homo sapiens
gctagtacgaggctggttcaaattcggcagagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310529 - DNA, 922 bp, Homo sapiens
  misc_feature (14)..(15): n is a, c, g, or t
aaataaggctaggnncgaggctgggtgtgaatcggccgaggtagctcttcggtggttgtcacacgtccggaggcctagccgtcgcgtacctaggatgccgcgtggaagccgaagccgcacctcccgcatggcccctccggccaggtgagaccatcgcagggtttgagaccaaagcgcggccgtccggactctactggggcaatgacgcagagggaggccgcgggcgggggtgaactaagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310530 - DNA, 1034 bp, Homo sapiens
  misc_feature (809)..(809): n is a, c, g, or t
  misc_feature (813)..(813): n is a, c, g, or t
gctagtacgaggctggttcaaattcggcagagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaacaaaaaaaaaanaaanaaacaaaaaagagaggaagaacaccaaaacaagaagaacaacacgagaaagaaccgacaaaagaaaaagaagaacgaaacaaaaaaaaaggagagagaagaggggcgggcgccaacaacgaagcatcgataaacgacggagactaaagaagaggcggggggccccacaaaaaaggcgggccgaagcgcgagtggctcacaaggagaggccggagcgctact

SEQ ID NO: 310531 - DNA, 679 bp, Homo sapiens
ggattgaggcagtgggaattcggcacgagatacatggcggtattgagcggagtccgctggctgacccgagcgctggtctccgccgggaaccctggggcatggagaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttcca

SEQ ID NO: 310532 - DNA, 1597 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaagtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctagctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaaaccattcttaatatatgcagttcccctgaa

SEQ ID NO: 310533 - DNA, 906 bp, Homo sapiens
gccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggtaggtaatttgtccaatttacatctgcttaattcacagtggaattcctggatcctgtagaacttagggtaatctgtgtttaataaattagagaagactttgttgaaatttctctagaattaactcctaacaactgggccggaggtttctagtcatttttatgagtaattttctgaattttcttcctttagaaggtataggccaggcacagtggctcacgcttgtaatcccag

SEQ ID NO: 310534 - DNA, 350 bp, Homo sapiens
ctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttaaaaatggcgctgcatatctttgcacctaccacttataacctgaatctcacctggatttatcatttaccgttgaaaaataagtcgctgtctcgtatatcttacatggaggctgtgacctgggc

SEQ ID NO: 310535 - DNA, 3848 bp, Homo sapiens
ctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttataaaactgctgcatttaacccagtgtgcatttaatgagtggctggtcgttgatacactcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 310536 - DNA, 3791 bp, Homo sapiens
ctgtttaatgtgagagaatagaaagaatgttcatggaatgtacctgccctgtaaaatgtttgatcattttcattaatgttgcagagaatccgactgctattaagagaaagtgaacaaattaagaatttaaaagacaggttcaggcatgtcataagtgaaaacaagaaggcttaatacaaacttgttgggttttgttcgtgtgtgtgtgtgtgtgtgtgtgtgtgtttttttttggttcagcctatctagccacctacaaataatcacatttctgttacctgaatttatttctcagcctgtaaaccttagtcactgttacctgtttcttgctcagtgaatatgatcttggcactgtcatctagaaagcaagatatttgattggttttctggttccttcgaagataataattccatatccagtttgactgattttcatacccctgaatcaactagttattttcatgaaatggtttttggatatctctcctctagtttggagaagtaataatcacaaagattaatattttgcttctagtacttacagtagaagaattttaaactggtacgtctactcctgttaaatagaaaggggattcgttgtattatgtgcttgcttttttttaatcaatagaataagattcaatgcatatttatgttttatattttccactattcaggtatcatgaaatcactctagagatgatcaatcaacatcatatttatacttttggttaattatatactactcagggaaaaaatgaacaaaaataactactcatccttcaatttcattttcttgaaacagtaagagtataatttggtatgcctcagctgtcaccattttataagtggctcattctgttcttaaagtaagtatttttattggaactcagggtaattgggggaatttatttagcttctaaaatatccggcaggatagagaagatttatttggcttcaaaaatgtctggtgaccacttctcttattagccactactgcccatttgcttcaaaaatatatttattggtctccaccatgtgtgacacacacaggatttccaaacataccacttttgagaaaaatgtgcagtaaaaaggaggtttctagaaagtgacagtaactcacatttaagcactagctgacctaggaggagacctggatcttcattctggttctgcctttcatgagacttaagacttggaggagccacctgtcctgtagaccccaagttcctcagccataagcaaacgggttaatcctaagagttcaggaccagttgggtgtcgtgaacggagccattagcaaggtctgtaggattcaaggacttgggcacattcacagtccacactattgtcatggtcattgacttactacttgagctcaaagccctgacatttcaaaaggttgtcatgataacagtgaaacctctgaatcccttaaatcagaaggcatggcaacatactttttctactggcaatagctcttacaatgagtgtttcataatgaaatagtctctgctgaagaaaacatgttttccttttgctctctctgctttgttggtttctgtgctgtgtggaattggagaagatatatgctctgaaatattttatacagattactgactactggacagggtttaccactatataacatctcaaagttattcaaggatatttaaagcatatttagtttagttacaccttattttaaaccgcagaaaacaatagctttaaaatttttgccattaaaataattataaatttatacttttactcaaggactagatcacagttttaggacaaaaatctctcctatttaaagttcataccttgtaagtatttagtttgtatattcatgaacaaatctggacatttatactttttttgtttccttatcaactgttcacaattattagttaattggtcttaacagttctacattataattgaaagaaaaattacttgagaaaataattgtttcagaatagtgcctactatatctgtgtcagctaaaaatttgtccagagttttagatataagctagtattttgtggagttttatccaggcgttaatagttcttcctggctgaaatttaatataggtgcagaatcctaaataacactgtgagatgtaatcttaactgccctcaataccttatcatcttagatgctgaaatttctgttttctccagcccttgtaaaagtgggtttcttgatgaacgcgtgctcccaatgctgaagcaaaagatttgcatttaaggagagaaatacaccctgaaatttgagtttgaaagattagaacatagagggtctctacagtgtttttctgcaacaccaagtagtcaaatctatttatagaaactctgattacaacagaaattttaaaatgaaattttccacatcggtattttgtaggaaagctcttataatcaatgcttaagctgctttttgaggcttttcttgtacagaggttgcagccaattacattttaattggtaggctgctgaataatgtttttgtatgttttaaaataatatttattttaataggttttttaacattatgcaaatcccaataaagaactgacacgttccataggccattgactgggaaattttgtgaaacacagcctaaatacacagtttttacaccaactaatttgtcttgcctttaaaactgattataactcttctttaagtacaacttttataaagaaaaaatacaacactaagactgtatgttctgtaaattatagtgtgatgacccatgcagaaccgctgtctgaagcttactcagcgattcatagccatctccagccatgttttatcaaatcacacactaaaaataaatggaaatgctacagtgaaaaaccaaaagttacagagcaacataagtaaaatgactaggcagtttcttagtaacatgtttgaaatgggaaaggtgactgactgcctttcaccagagtcttagctgtttcacgttcactattttaggttaattttcttgggaaatcaatttgaatattcccccctgtccttttgcattaaaggacgaaaatatatgttgagagtttgacagactttttaaatatgcctctttcccaattttatgtatttttggttctgcgcacacagatttatcaatgaagtacatttgcctctggctttatcacaaggaaaaaggaatcaaacattgaacacaaatgtgttccaaaccagtcttgtccatcttgtcacttttatgtgactgctcctctgaaccagaaggggcacgatagaaggccataggaatgaaagtaaatcattcaggtgaagtgagaaattcttccatatacagagtgaaaatgtgtgatttcattcctgccttcctttaaacgttgtcttgatctctgcctagtagtagttgagccctcagtcgcccaaacatgaggagagacccaactccagcagccagaatttagtatttacatttgccttcccaagttgagaatagaatgtggtgttctgtgctttctgtttttattattccaaaatatttttttaaagaagtgttatttttcaacagattcataaattagttcctgatgtacggtaaattaaaactcccactgtgtcagtcaaactgagatgtgctcatttcataaccactcatttctagtctgtcagagctgcactggtggcttattgctggtttttaaaggtgtttttaacttacatgtaacatgtttaggacatgttttttttttctaatttgtgtgtctttacaactgattaaacagtagtttaaaaata

SEQ ID NO: 310537 - DNA, 3778 bp, Homo sapiens
  misc_feature (1386)..(1386): n is a, c, g, or t
acccaggatacactgcgcagtctgggggcggggccggagttcaagcctcggaggaagtaaatgcaaatctaagcgagcgctgtggggcgcttttcaggatgtccagcaaagaatcctgtgggaaaaaagagacatctcagaggaaagacaccaccacctcatcacccaattttggtgaaaaagacaagaaagagagaaaaaccccagcaagttctactagttcgtcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggagttaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagntagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaagagaacttgttcagg

SEQ ID NO: 310538 - DNA, 3928 bp, Homo sapiens
  misc_feature (1536)..(1536): n is a, c, g, or t
acccaggatacactgcgcagtctgggggcggggccggagttcaagcctcggaggaagtaaatgcaaatctaagcgagcgctgtggggcggtgagtaggtagtgcggatgcgggcgcagaactacgtttcccagcaggcatacagttggtggggcggggtgtgtgtgtgtgttgggaggcgggggtccctctcctttggcttggggctccggagttgccactgccgccggcgctggtaagcttttcaggatgtccagcaaagaatcctgtgggaaaaaagagacatctcagaggaaagacaccaccacctcatcacccaattttggtgaaaaagacaagaaagagagaaaaaccccagcaagttctactagttcgtcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggagttaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagntagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaagagaacttgttcagg

SEQ ID NO: 310539 - DNA, 3768 bp, Homo sapiens
  misc_feature (1376)..(1376): n is a, c, g, or t
agcgggggtgcgggcccgagccctcgctggccggcgggtctaggactgatcatgaacggcaggcggtgacctcgcccgcaccattgcatgtcccggacctcaatcctgtgggaaaaaagagacatctcagaggaaagacaccaccacctcatcacccaattttggtgaaaaagacaagaaagagagaaaaaccccagcaagttctactagttcgtcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggagttaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagntagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaagagaacttgttcagg

SEQ ID NO: 310540 - DNA, 3492 bp, Homo sapiens
  misc_feature (1386)..(1386): n is a, c, g, or t
acccaggatacactgcgcagtctgggggcggggccggagttcaagcctcggaggaagtaaatgcaaatctaagcgagcgctgtggggcgcttttcaggatgtccagcaaagaatcctgtgggaaaaaagagacatctcagaggaaagacaccaccacctcatcacccaattttggtgaaaaagacaagaaagagagaaaaaccccagcaagttctactagttcgtcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggagttaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagntagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatgga

SEQ ID NO: 310541 - DNA, 1259 bp, Homo sapiens
acccaggatacactgcgcagtctgggggcggggccggagttcaagcctcggaggaagtaaatgcaaatctaagcgagcgctgtggggcgcttttcaggatgtccagcaaagaatcctgtgggaaaaaagagacatctcagaggaaagacaccaccacctcatcacccaattttggtgaaaaagacaagaaagagagaaaaaccccagcaagttctactagttcgtcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggagttaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccaggtaaggtagtaaaaaatgaagaatataggttttaactgagagtttattaatatagttaagttttttctgtatttctatatttttttctgttttttttttttgttgttgttgtttgttttttgtttttgaggcggggtctcgctccgttgcccactgcattccagccttggtgacagaacaagaccctctctctct

SEQ ID NO: 310542 - DNA, 2919 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtc

SEQ ID NO: 310543 - DNA, 2480 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactattt

SEQ ID NO: 310544 - DNA, 550 bp, Homo sapiens
gtttgggtttgggttaggttttatgagctccttgtaagcaggcactatgggttagctttttggttttttaggttttgctttgctttttactttaaattttgtacaactgctagcagagtaacaagtatatgtagagatatttaatttgtttaaaaattcctctattattctgactataattgctttaaaatccctcaaataatcctatcttcaaagaataaataattgtattgaagggttgttaggcttagcccagagctagggcaataaatagaatgtcttcagaaagacatgtgaagggtacacataaacactgtgaagaaaaacactgtctgtgaggcatgatgggaactgaaaacataacataaaatataaatgggtgggaagattaggatctctagtttcctttcagactgggctttggattctacaaacctgcatttgaatcccaactctgctgccatttaactgaatgtgttgactaggaaaagagacagtttctcaagtttcagttttcttaattccgaaatggtaaaaaaaaaaaaaaaaa

SEQ ID NO: 310545 - DNA, 331 bp, Homo sapiens
ctgttgggaaaatcccagtcgtatggagtaatccttccttctattctatgttttataggtcaggcctaggtgaaagggctgggagttacaaaggcctgcctgtttactaagggaatatcagcctgtcttcatttcactgtttcctttcaggatttcaatgatgaattctcagatctggatggagtggttcaacaaagaaggcaagacatggaaggatatagcagttctggttctcaaactcctgaatctgagaactctcgagatttgggaaattgttgtattttgactaaaatttaattcccctcaaaacatcctcaccccacccccttaa

SEQ ID NO: 310546 - DNA, 1452 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggtaagttgcccacataactatctaaatgcaaaagaaagggaatatgtcccacaattacacttgtgcttacaccatgaccagggtgtgggaagagcttaggaccaaaatatttgaggtacagttgaagaaacagggcatatcttccttgaagaagaggaaaccatagtagccataaactttttccaagtaattgaagagttgtcctgcaaaaagaaagaaacacctagtagactatcttggtgagttactggtcagtgaatgcattcataaaatcttgctctgtttgcttgtcaatattggcttagagggattcacaaatctatttgaggtaggactgaatcatcccacaaatccttaaatgtcttctgtgttcaaggcaccatgctagtgcacactgtaggataccaggaaaaattaaaactaatttatgccttcagagacttcacaacttagaagagaaatgaatatgctcagaattaactgtaaaaaaaaaaa

SEQ ID NO: 310547 - DNA, 2865 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggtaaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtc

SEQ ID NO: 310548 - DNA, 1138 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttgggaaattgttgtattttgactaaaatttaattcccctcaaaacatcctcaccccacccccttaa

SEQ ID NO: 310549 - DNA, 1495 bp, Homo sapiens
ggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggtaagttgcccacataactatctaaatgcaaaagaaagggaatatgtcccacaattacacttgtgcttacaccatgaccagggtgtgggaagagcttaggaccaaaatatttgaggtacagttgaagaaacagggcatatcttccttgaagaagaggaaaccatagtagccataaactttttccaagtaattgaagagttgtcctgcaaaaagaaagaaacacctagtagactatcttggtgagttactggtcagtgaatgcattcataaaatcttgctctgtttgcttgtcaatattggcttagagggattcacaaatctatttgaggtaggactgaatcatcccacaaatccttaaatgtcttctgtgttcaaggcaccatgctagtgcacactgtaggataccaggaaaaattaaaactaatttatgccttcagagacttcacaacttagaagagaaatgaatatgctcagaattaactgtaaaaaaaaaaa

SEQ ID NO: 310550 - DNA, 1466 bp, Homo sapiens
tgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccagacctggaactctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggtaagttgcccacataactatctaaatgcaaaagaaagggaatatgtcccacaattacacttgtgcttacaccatgaccagggtgtgggaagagcttaggaccaaaatatttgaggtacagttgaagaaacagggcatatcttccttgaagaagaggaaaccatagtagccataaactttttccaagtaattgaagagttgtcctgcaaaaagaaagaaacacctagtagactatcttggtgagttactggtcagtgaatgcattcataaaatcttgctctgtttgcttgtcaatattggcttagagggattcacaaatctatttgaggtaggactgaatcatcccacaaatccttaaatgtcttctgtgttcaaggcaccatgctagtgcacactgtaggataccaggaaaaattaaaactaatttatgccttcagagacttcacaacttagaagagaaatgaatatgctcagaattaactgtaaaaaaaaaaa

SEQ ID NO: 310551 - DNA, 1515 bp, Homo sapiens
tgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccagacctggaactctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggtaagttgcccacataactatctaaatgcaaaagaaagggaatatgtcccacaattacacttgtgcttacaccatgaccagggtgtgggaagagcttaggaccaaaatatttgaggtacagttgaagaaacagggcatatcttccttgaagaagaggaaaccatagtagccataaactttttccaagtaattgaagagttgtcctgcaaaaagaaagaaacacctagtagactatcttggtgagttactggtcagtgaatgcattcataaaatcttgctctgtttgcttgtcaatattggcttagagggattcacaaatctatttgaggtaggactgaatcatcccacaaatccttaaatgtcttctgtgttcaaggcaccatgctagtgcacactgtaggataccaggaaaaattaaaactaatttatgccttcagagacttcacaacttagaagagaaatgaatatgctcagaattaactgtaaaaaaaaaaa

SEQ ID NO: 310552 - DNA, 2866 bp, Homo sapiens
tgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtc

SEQ ID NO: 310553 - DNA, 822 bp, Homo sapiens
cacacatgtgggtttcaagtgcggctggtgccatccctctgagcagacgctgaaagagaaaacttctgagatagcacttgtgagcgaaaagcacaccaactggctcaaagagctgtggttgggcagatctggtgtaaatacaaagttccttcccgacatttcccagagtttcttgaagatcacctggcctctagaagatgacaaggagacagcaagtcctacaagcaaaaaggagcattcagcaaacattccaagcacagcttatgccctggaagagtatgttccacgggagagaagtgaagccagtgggtccagacctggaactgtaagtgacaggtctcagacctggaaaaaccatttgggagtggagtgtggcttctgtggtttaaaaggcctttttggtatcttaaggacagagtgtctccacatggagaatgtctttgattgcccactgggggagttttccttgtttatcatcagggtcttgagtaaaagcaagaattatcccacatactgtaatgtcctcagaaacccctgatacaagtacattttgcttataggtgtattgcacaaaactggaagtttgaggtttgtcatgtcactcaagctgaaaggggaattcaagtggagacagcagtgagcaatgctaggagtggcttgaaagatacagttgcaatctaagactctatgtgttcgggagaactcagtatttgccatttcagctcaggaaaactaggattataagatatttgcatgaagtcacacttgccatgtcaactctctacattttggttttaggttccttttaacctagaaaggtag

SEQ ID NO: 310554 - DNA, 1352 bp, Homo sapiens
gaatcattgcactccctactagagcggatgtgatgagggaaaaggagaactcagcactttccctgcaggaaccggctccctcggaggggcgtggctgggaggagctgtgagtaacgtgccacagtgttgtaaaaacccagtgagtgttataaaaacccagtcagcctggctcctgttgaatagtctaccccccttgcactctacctgacacagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaagggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatac

SEQ ID NO: 310555 - DNA, 1499 bp, Homo sapiens
gaatcattgcactccctactagagcggatgtgatgagggaaaaggagaactcagcactttccctgcaggaaccggctccctcggaggggcgtggctgggaggagctgtgagtaacgtgccacagtgttgtaaaaacccagtgagtgttataaaaacccagtcagcctggctcctgttgaatagtctaccccccttgcactctacctgacacagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaagggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatactacacaacacaccacaaccgcgaacaaacacaaaccgcaaccacacgcagcgagcagtggaagaaccacgccagccaaaagcagccgaagcaaccgagacgacacgcccaaatccacgcgccagcaccgcaggccagcgcccggacg

SEQ ID NO: 310556 - DNA, 826 bp, Homo sapiens
gaatcattgcactccctactagagcggatgtgatgagggaaaaggagaactcagcactttccctgcaggaaccggctccctcggaggggcgtggctgggaggagctgtgagtaacgtgccacagtgttgtaaaaacccagtgagtgttataaaaacccagtcagcctggctcctgttgaatagtctaccccccttgcactctacctgacacagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagccaagcactccgttttgcaaaaggtgcccttcctgtccattccaaatagccacctcctctttcgagggtcctctagagcgcccg

SEQ ID NO: 310557 - DNA, 988 bp, Homo sapiens
tgtgttgttgtgtaatcgttcttatgtggccgttagtgatctctctttgtttttgtattccgggaagtgtgtgataataattgttgggtctagttaataagatgttggattataatgtagatttttggtaattgtccttgaaatgtgcgtgctgacaagatttgagggagattcagtattaatataagaggggtttaggggtcgtaggaaagtggggcaacaactaatagttgttgttaaattggttaaaaatagtagggggatgatgctaataactaggcctgtgggtgttgtgtcgatccaaaataaggtgttttctgggacagtcatgtccagtggtagtcatataattgttgggacgattaggttttagcattgagttagtttagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310558 - DNA, 847 bp, Homo sapiens
cacaaccaacacaaaagaggaaataaggctaggtacgaggctgggtgttggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggcagagagagtgtcaaagagacgatgactgggtgcaggagggcatgggtaaaagacccactgtaccg

SEQ ID NO: 310559 - DNA, 921 bp, Homo sapiens
cacctacctccctcaccaaagcccatacataataaaaaattataataaaccctgagaagcaagaatgaagcgaaaatctgttcgcgttcattgcattgtcgcccgcatcaatcctaggcctagcccgctcgcagtactgatcattctattatccccctctattagatccccacctccaaatatctacatcgaacaaccgactaaatccaccaacccaacaatgactaatcaaactaacctcaaatacaaataataaccatacacaaacactaataggacgaagctgatctcttatactagtatcctttaatcattgtatattgccacaaataatcctcctcggactcctgacctcgactcgattatactaccaaggcacccaactatctgagtaaaccatatgcccagtgggccatccctcttatcgatgcgggtcgcagatgattagtaggctattcgtctctaagattcaaaaaatgccctagacccacttctgtaccacagaggcagcacctacgccccgttatccccatactagttattaatcgaaagcactttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatctt

SEQ ID NO: 310560 - DNA, 265 bp, Homo sapiens
  misc_feature (24)..(24): n is a, c, g, or t
  misc_feature (27)..(27): n is a, c, g, or t
gagagatcccatgcaaaggcttanttnccaggagagagatgtgaaagataatgcagagctgtataggcacgcactcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatctt

SEQ ID NO: 310561 - DNA, 436 bp, Homo sapiens
tgtggttccattcttgattttatagaaaggagaagaaaaaaaaacaattgttttccttgttgaggggggatgtctggatcttaggcagagaaagtaacttcaacttcatcgagacggcaaatggcggacttcgacacctacgacgatcgggcctacagcagcttcggcggcggcagagggtgaggcgggcgtgcgcgggccccgtcgggggctgcgggaccggcggagtcggggccgtcagggtggcggccgtcctgcgctcagccggggcggcgggaggcgggggcccgcggaggcctaggagcggcgcctggagggccggggcctggaaatggcgcgctcggagacggggcggcggcggctgggctcccggggtcttgcttgcggggcggatcccttccactgcctcccgccaacgacaacgtgttggtttttg

SEQ ID NO: 310562 - DNA, 2575 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310563 - DNA, 2556 bp, Homo sapiens
gacccacgcgtccgcggacgcgtgggtcgacccacgcgtcgcggacgcgtgggtcgcggacgcgtgggtccgagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310564 - DNA, 2525 bp, Homo sapiens
gacccacgcgtccgcggacgcgtgggtcgacccacgcgtcgagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310565 - DNA, 2671 bp, Homo sapiens
  misc_feature (2593)..(2593): n is a, c, g, or t
  misc_feature (2597)..(2598): n is a, c, g, or t
  misc_feature (2601)..(2601): n is a, c, g, or t
  misc_feature (2605)..(2605): n is a, c, g, or t
  misc_feature (2611)..(2611): n is a, c, g, or t
  misc_feature (2620)..(2620): n is a, c, g, or t
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaataaaaaaaaaaaactggggntatnnggngggnaaaggntgaatggcnggcttgcgttcgcccttttgaaagggattcgggccctgggggtataacgtt

SEQ ID NO: 310566 - DNA, 2548 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatctt

SEQ ID NO: 310567 - DNA, 2838 bp, Homo sapiens
  misc_feature (2638)..(2638): n is a, c, g, or t
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaataaaaaaaaaaaaaaaaactcgagatatattaccatgatgaaatgatgtaaattgcttggataantaaacccaacatttactctgcattgagaaagccaagtcattttactttaaatagtaaataggcgtaaaacgaccttttggattggaagagctcaaacagattaaaataattggacactgcagcctaactaacttcctataatccctaggattattcaaagccatgcttaagtagagatattagagtaggaaaccatataa

SEQ ID NO: 310568 - DNA, 2609 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatagaacaaaaaaaagggcggccactcgcgatctaga

SEQ ID NO: 310569 - DNA, 2521 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacaggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310570 - DNA, 2595 bp, Homo sapiens
cacaaccaacacaaaagaggaaataaggctaggtacgaggctgggtgttggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310571 - DNA, 2635 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310572 - DNA, 2572 bp, Homo sapiens
ttgtttctccagccattctctgtaacagtcttgtggtacatcgagcagagtgcctcacctggggcgctggcggcgtagctcagcggaagaccgctttacttgttttgcttattccactctgggcacacttgaatcctgtttgtctcccctcctagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310573 - DNA, 2293 bp, Homo sapiens
tgacgtccttgttcagcacgctggagtgtacggctagtcagagacaaagacacagaaatttataggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310574 - DNA, 2076 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttggttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310575 - DNA, 2497 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310576 - DNA, 2407 bp, Homo sapiens
cacaaccaacacaaaagaggaaataaggctaggtacgaggctgggtgttggagacggcaaatggcggacttcgacacctacgacgatcgggcctacagcagcttcggcggcggcagagggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310577 - DNA, 2180 bp, Homo sapiens
gtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310578 - DNA, 2168 bp, Homo sapiens
  misc_feature (2037)..(2037): n is a, c, g, or t
  misc_feature (2042)..(2042): n is a, c, g, or t
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagcngtganatcttcgtcccatgcccgtgccttgggccattggggggccgctggcctggaaaagccccccggttgttgcccgttgttgggcccgcgttcgtttggcccccctccgggtccctcgttttagcccac

SEQ ID NO: 310579 - DNA, 2207 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagccccccgtatgtgggggagggcacgggggtagggccgttggagactggaaagccccttgggtgtgaccgtagtaaaacttctgtgccccgtcccccgtgttgctgggggcgcctggtggcgcggcgcagcacgtgtgaaaacccgcggttgtggccgggctgtgtccccatgtgtttgtgaccccacgctctctgtgttgatcagcgccacctctccgtgaggaggtggag

SEQ ID NO: 310580 - DNA, 1393 bp, Homo sapiens
cacaaccaacacaaaagaggaaataaggctaggtacgaggctgggtgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310581 - DNA, 1551 bp, Homo sapiens
  misc_feature (65)..(65): n is a, c, g, or t
  misc_feature (117)..(117): n is a, c, g, or t
  misc_feature (156)..(156): n is a, c, g, or t
gtaaaacgtcaacgggatgccagcagtttagatgcatgtgtttggttctttatcttatccacatngaagatgtaagtaggtcatctgaaagcatcgggttggattacaccacataangcatgtctttctgaagttaagtgtgggtgttacacaaanggttcttatctcagaagcagagaagctgacaggtggaaggaaggagagagagagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310582 - DNA, 1764 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcaggggccgcaccagctggctcttctctttgatgaggaagagggcgaatacctgcacttcctgaggctccgtgatacccatttgccggcacagctcctcctgcacttctgctgctactgtgaaagtctggatattcgtcctataatccacac

SEQ ID NO: 310583 - DNA, 1625 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgtttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310584 - DNA, 1615 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccacacatggatttcagagaacccaacagaagagggaaggagcacagagaccacgaatccagggtttaagacctcgaaacagtcgagaaggcccctcaattcaagtaggccaatcccaattctgcttatcttcggggggtgccagggctacgagaggaagtcgttcaaaaggagccagat

SEQ ID NO: 310585 - DNA, 1592 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagcttcctgcttctgccgtctactcctctcagccttctgctgcccccagggctacctcttggttcctaacccacacctcctatccgttctcttttcattaagctctcccaagccacctaactccaggtctccatcccgcatctcctcctcctcctccctctctcctttccagctcctgcctcttctcccctctctccttttcacctgcttcctgcttctgt

SEQ ID NO: 310586 - DNA, 1349 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310587 - DNA, 1228 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310588 - DNA, 804 bp, Homo sapiens
agtacggtccggcccatggaaattgatcaagcaatacccatttcccccgtgcacctattctgagcttccttccctcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaata

SEQ ID NO: 310589 - DNA, 696 bp, Homo sapiens
  misc_feature (650)..(650): n is a, c, g, or t
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcagagatggccctcccctccgtggatccaacatggatttcagagaacccacagaagagnacagaacacagagaccacgccacccctgctggtaccagctcgattc

SEQ ID NO: 310590 - DNA, 503 bp, Homo sapiens
tcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggttgtacggcgtgtgcagcaacaacttcgtccatactgacttgtctgggctctcggcgtgtgca

SEQ ID NO: 310591 - DNA, 373 bp, Homo sapiens
cccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggtgagtttgggggattcttattgtatattactgtaaagtgtaggggaggatgggaaggggttctaaataaaaatagatttgtgaaccagaggctgtaatcaagaaagtgttttaaacatttgcctggtctaagtggccgaaagaaacataactcttcaactcataggtcttcagttcacttagggga

SEQ ID NO: 310592 - DNA, 495 bp, Homo sapiens
tgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgc

SEQ ID NO: 310593 - DNA, 557 bp, Homo sapiens
  misc_feature (41)..(41): n is a, c, g, or t
  misc_feature (401)..(401): n is a, c, g, or t
  misc_feature (449)..(449): n is a, c, g, or t
  misc_feature (455)..(455): n is a, c, g, or t
cccttgaaatacttaaatgtctctacttaaaatacagaaanttcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310594 - DNA, 474 bp, Homo sapiens
gaatctgttcggctgtggctctatctgaagacaatgagaaggtttgggtgagagcaggtgcaaacgtggacagagcactggcctgagagtcagcatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctagattccatttgggggattccattgggggattccatttgggggaatccatttggg

SEQ ID NO: 310595 - DNA, 856 bp, Homo sapiens
  misc_feature (363)..(363): n is a, c, g, or t
  misc_feature (483)..(483): n is a, c, g, or t
  misc_feature (534)..(535): n is a, c, g, or t
  misc_feature (565)..(565): n is a, c, g, or t
  misc_feature (571)..(571): n is a, c, g, or t
  misc_feature (593)..(593): n is a, c, g, or t
  misc_feature (635)..(635): n is a, c, g, or t
  misc_feature (672)..(672): n is a, c, g, or t
  misc_feature (833)..(833): n is a, c, g, or t
  misc_feature (837)..(837): n is a, c, g, or t
  misc_feature (843)..(843): n is a, c, g, or t
  misc_feature (847)..(847): n is a, c, g, or t
gcggccgcctactactactaaattcgcggccgcgtcgacagccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctacaacccccctcctaatactaactacctgactcctacccctcacaatcatggcaagccaacgccacttatccagtgaaccactatcacgaaaaaaactctacctctctatactaatctccctacaaatctccttaattataacattcacagncacagaactaatcatattttatatcttcttcgaaacacacttatccccaccttggctatcatcacccgatgaggcaaccagccagaacgcctgaacgcaggcacatacttcctattctanaccctagtaggctcccttcccctactcatcgcactaatttacactcacaanncctaggctcactaaacattctactactcancctcantgcccaagaactatcaaactcntgagccaacaacttaatatgactagcttacacaatagctttnatagtaaaaatacctctttacggactccacttatganccctaaagccatgtcgaagcccccatcgctgggtcaaatagtactttgccgcagtactcttgaaactaggcggctatggtataatacgcctcaactcattctcaacccctgacaaacacatagctacccttcttgtactatcctatgaggcataattatancagntccatntggntagaaaaca

SEQ ID NO: 310596 - DNA, 634 bp, Homo sapiens
ggtgtaaccggatcaggtttatcagcaaactaaagagatgagttggagagtatgatagatattctaacgagcctttctgagtactttcaagagttttagagcatgtttctttgtctaaatgtctagtctcctttcgtattatacatgggttaaggagaccttttatacaggcacatgaccggcctacttaacaatgactcaaataggtttccaagtcacaaataaaatggagaagaaaggaataaagagaaagggggagaagaaatgaggtaatatggcaatggcagaaaagaaatttcagttggagggatctaacagaggctgtgtgcttatcaagaaatggtacgaggccaggtgtcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctacaggctggagtgcagtggcacgatttcagctcactgcaacctccgtctcccaggttcaagcgattctcctgcctcagcctcctgagtagctgggattacaggcata

SEQ ID NO: 310597 - DNA, 274 bp, Homo sapiens
gtgtactggctgcacgtcgatcgggcgaggcgttgaatcaggtgtctcagtgatcacctgtaccgtgagaccgtcgctcctggaatatttccccgtcacgcaagtcgtgaaggaggggtgaaccggcccaggtcggaaacggagcaggtcaaaactcccgtgctgatcagtagtgggatcgcgcctgtgaatagccactgcactccagcctgagcaacatagcgagacccctcttaaaagaaaaatataatacgttaattttggactctcaaga

SEQ ID NO: 310598 - DNA, 301 bp, Homo sapiens
  misc_feature (278)..(278): n is a, c, g, or t
gcggccgcctactactactaaattcgcggccgcgtcgacagccaggtcaaaactcccgtgctgatcagtagtgggatcgcgcctgtgaatagccactgcactccagcctgagcaacatagcgagacccctttaaatcaagaaaacctaaaaaaacattttcatttacatagcaccaaatataagagccttttttttttaacctagaaagagtattttggagagagaaactaaggatcagaaggtttaagagtatcaaaaatctgaggccagtcctcancatcgtgtaatcccacgaccttt

SEQ ID NO: 310599 - DNA, 734 bp, Homo sapiens
  misc_feature (578)..(578): n is a, c, g, or t
  misc_feature (626)..(626): n is a, c, g, or t
  misc_feature (632)..(632): n is a, c, g, or t
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310600 - DNA, 824 bp, Homo sapiens
  misc_feature (578)..(578): n is a, c, g, or t
  misc_feature (626)..(626): n is a, c, g, or t
  misc_feature (632)..(632): n is a, c, g, or t
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggctacaagaaaaaaaaaaaaaaggtttttcccaggttgagagggcaaggttagtaccctagtaccctatgtccttggctggagaatcaaattgtcaagttagggccctcggatacaacccattttttttcctagactacctgggctctttatacccaactggt

SEQ ID NO: 310601 - DNA, 836 bp, Homo sapiens
  misc_feature (680)..(680): n is a, c, g, or t
  misc_feature (728)..(728): n is a, c, g, or t
  misc_feature (734)..(734): n is a, c, g, or t
cgaacatgtcggggcttagaaggtaaataaaataataatatttcttagaattttctgactatccttaaatcctgcaggtaaattattcccaacaaattttcaaaaggcaatcaataataagtaggttcttcttcaataacatgagcatatgcttcttaaagactgggtgacgccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310602 - DNA, 739 bp, Homo sapiens
  misc_feature (583)..(583): n is a, c, g, or t
  misc_feature (631)..(631): n is a, c, g, or t
  misc_feature (637)..(637): n is a, c, g, or t
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310603 - DNA, 689 bp, Homo sapiens
  misc_feature (578)..(578): n is a, c, g, or t
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggtggctagaccctcatcctcctgtagctttctgcatccatttcctagatgtcatggaggtgatctctac

SEQ ID NO: 310604 - DNA, 682 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccacgcccgg

SEQ ID NO: 310605 - DNA, 697 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctctctactaaaaatacaaaaaattagccgggcgtggtggcgggcgcctgtagtcccagctactggggaggctgaggcaggagaatggcgtgaacccgggaggcggagttgcagtgagccgagattgcgccactcagtcgcagtccagcctgggcgacagagcgagactccgtctcaaaaaaaaaaa

SEQ ID NO: 310606 - DNA, 676 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaattagccaggcatggtggcgcacctgtaatcccagctactcaggaggctgaggcaggagaatcacttgaacccaggaggcagaggttgcagtgagccgagatggcaccactgcactccagcttgggagtgcagattgagactc

SEQ ID NO: 310607 - DNA, 652 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaggcaacctggtggtcccccgctcccgggaggtcaccatattgatgccgaacttagtgcggacacccgatcggcatagcgcactacagcccagaactcctggtcgacgcggccgcgaatttagtagtagtaggcggccgc

SEQ ID NO: 310608 - DNA, 658 bp, Homo sapiens
  misc_feature (518)..(518): n is a, c, g, or t
  misc_feature (647)..(647): n is a, c, g, or t
  misc_feature (656)..(656): n is a, c, g, or t
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaaaaanaaagaaaaaagacaaggagatggaatcaaagcccagaggtcctccccttcttcagagccaccactagttctcttgttgaccatgggaaaactacccccagccccactgcctttttgcctccggtcagtngggtttttncg

SEQ ID NO: 310609 - DNA, 553 bp, Homo sapiens
  misc_feature (397)..(397): n is a, c, g, or t
  misc_feature (445)..(445): n is a, c, g, or t
  misc_feature (451)..(451): n is a, c, g, or t
tagtgctgcctctggtggtactcctccgccgggcgcggtcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310610 - DNA, 672 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaaaaaaaaaaaaaaaaaagaaagcacatttttttcctttatgtaataaattaccagtctcagatactcagttatagcaacagaaaacggagtaagacagcgttaatatgtaatgtgttaatttgtatgatttttacatgaattaaaaaatattcaaacaa

SEQ ID NO: 310611 - DNA, 685 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaggcaacctggtggtcccccgctcccgggaggtcaccatattgatgccgaacttagtgcggacacccgatcggcatagcgcactacagcccagaactcctgggctcaagcgatcctcccacctcagcctcccgagtcgacgcggccgcgaatttagtagtagtaggcggccgc

SEQ ID NO: 310612 - DNA, 611 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctataagaaattagccaagcatggtcgcacgtgcctgaagtttccagttactcaggagctgaggtggaaggatcaattgagcccaggattttgaggctgca

SEQ ID NO: 310613 - DNA, 585 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctactaaactacaaaagtagctgggctgtagcccacgcctatatcccagcgacagcgagatgcggtaccgagctc

SEQ ID NO: 310614 - DNA, 650 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaattagccaggcatggtggcgcacctgtaatcccagctactcaggaggcggaggttggagtgagccaagactgcgacattgcactccaggctgggcaacagagtgagacttcatctcg

SEQ ID NO: 310615 - DNA, 605 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaaaaaaaaaaattccatgtgcatgaacatattctaagagagagtgagaaagcacagatttttatgcaaggtatctccaatgtttcctgaattg

SEQ ID NO: 310616 - DNA, 554 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctcttaaaagaaaaatataatacgttaattttggactctcaaga

SEQ ID NO: 310617 - DNA, 540 bp, Homo sapiens
  misc_feature (384)..(384): n is a, c, g, or t
  misc_feature (432)..(432): n is a, c, g, or t
  misc_feature (438)..(438): n is a, c, g, or t
gctcgattccccttttggggtctttgcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310618 - DNA, 542 bp, Homo sapiens
  misc_feature (386)..(386): n is a, c, g, or t
  misc_feature (434)..(434): n is a, c, g, or t
  misc_feature (440)..(440): n is a, c, g, or t
tcactcggtacggtgttatcgatgccaccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310619 - DNA, 653 bp, Homo sapiens
  misc_feature (132)..(132): n is a, c, g, or t
  misc_feature (497)..(497): n is a, c, g, or t
  misc_feature (545)..(545): n is a, c, g, or t
  misc_feature (551)..(551): n is a, c, g, or t
caggtgcagtggctcacacctgtaatcccagcactttgggaggccaaggtgggtggatcacttgaggccaggagttcaagaccagcctggccaacatggcaaaaccctgtctctactaaaaataaaatacanaaaattacgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310620 - DNA, 679 bp, Homo sapiens
  misc_feature (158)..(158): n is a, c, g, or t
  misc_feature (523)..(523): n is a, c, g, or t
  misc_feature (571)..(571): n is a, c, g, or t
  misc_feature (577)..(577): n is a, c, g, or t
taatatctggtcgatatatttctaatatgtttcagtagtgtaactgtggaaaatgttcactttgggaggccaaggtgggtggatcacttgaggccaggagttcaagaccagcctggccaacatggcaaaaccctgtctctactaaaaataaaatacanaaaattacgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310621 - DNA, 711 bp, Homo sapiens
  misc_feature (555)..(555): n is a, c, g, or t
  misc_feature (603)..(603): n is a, c, g, or t
  misc_feature (609)..(609): n is a, c, g, or t
tgcatccgtgcatgggtgactcttagatgtatcccctcctcgatcgcaacttcaaaaattcatctattatgccgggcgcggctgtgctcacgcctgtaattcccagcactttgaggaggtcgatggactgcgagaacactagcgcaggagatcgagaccacggtgaaaccccgtctctactaaaaatacaaaaaattcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310622 - DNA, 694 bp, Homo sapiens
  misc_feature (538)..(538): n is a, c, g, or t
  misc_feature (586)..(586): n is a, c, g, or t
  misc_feature (592)..(592): n is a, c, g, or t
tcaaaccacatgaaatattttggactcttatactaattccaacactttgaagatctggggagaacaaactagattggtgctttccttggcttagtatgttctgtttttatagggagagcaaattattgttcaccagcactattaaaatagctacaacaggatgggcatggtggctcacaccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310623 - DNA, 647 bp, Homo sapiens
  misc_feature (491)..(491): n is a, c, g, or t
  misc_feature (539)..(539): n is a, c, g, or t
  misc_feature (545)..(545): n is a, c, g, or t
acagtggctcacccctgtgatcccaacactttgggagactaggaagggaggattgcatgagcccaggagttccagaccagcctgagcaacatggtgagacttccatctctacgaaaaattttataaaaattagcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310624 - DNA, 679 bp, Homo sapiens
  misc_feature (523)..(523): n is a, c, g, or t
  misc_feature (571)..(571): n is a, c, g, or t
  misc_feature (577)..(577): n is a, c, g, or t
caggcacagtggctcacccctataatcccaacactttgggaggccgaggcaggcggatcacctgagatcgggagtttgagaccagcctggccaacgtggtgaaaccccatctctactaaaaatacaaaataagccgggcgtggtgacgcatgcctgtaatcccagcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310625 - DNA, 617 bp, Homo sapiens
  misc_feature (461)..(461): n is a, c, g, or t
  misc_feature (509)..(509): n is a, c, g, or t
  misc_feature (515)..(515): n is a, c, g, or t
gaagtgacttccaggggacttcaaaagccagcatcctgtttttcctcccttcatttttcttttgacccccttttgtaagccagatgttaaaaacttggaccttcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310626 - DNA, 556 bp, Homo sapiens
  misc_feature (400)..(400): n is a, c, g, or t
  misc_feature (448)..(448): n is a, c, g, or t
  misc_feature (454)..(454): n is a, c, g, or t
gcggccgcctactactactaaattcgcggccgcgtcgacagccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310627 - DNA, 581 bp, Homo sapiens
  misc_feature (425)..(425): n is a, c, g, or t
  misc_feature (473)..(473): n is a, c, g, or t
  misc_feature (479)..(479): n is a, c, g, or t
tgggcggatcatgaggtcaggagatggagaccatcctggctcacactaaaaatacaaaaaagttaaccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310628 - DNA, 547 bp, Homo sapiens
  misc_feature (391)..(391): n is a, c, g, or t
  misc_feature (439)..(439): n is a, c, g, or t
  misc_feature (445)..(445): n is a, c, g, or t
tcacccacaaaccccctcacccacaaaccccctcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310629 - DNA, 714 bp, Homo sapiens
  misc_feature (558)..(558): n is a, c, g, or t
  misc_feature (606)..(606): n is a, c, g, or t
  misc_feature (612)..(612): n is a, c, g, or t
taatcctctgcactttgattctggaggttgtttactcagttgatcatagacccaggctgcttctcccaattgagggatcccaggcaaagcctgtggtcaggctccaaaacagcttttcaggccccatcttttacagctgatgctgtcgcatacccttcaaaagactttcaggacttggtccttcaacaatagtattctgtcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310630 - DNA, 537 bp, Homo sapiens
  misc_feature (381)..(381): n is a, c, g, or t
  misc_feature (429)..(429): n is a, c, g, or t
  misc_feature (435)..(435): n is a, c, g, or t
ggtccacttatcacggttggctgcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310631 - DNA, 575 bp, Homo sapiens
  misc_feature (419)..(419): n is a, c, g, or t
  misc_feature (467)..(467): n is a, c, g, or t
  misc_feature (473)..(473): n is a, c, g, or t
atgcactgtgatgcctcttgctccttgagtacatttttgtatattgtgatgagggtccagtcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310632 - DNA, 729 bp, Homo sapiens
  misc_feature (641)..(641): n is a, c, g, or t
  misc_feature (645)..(645): n is a, c, g, or t
  misc_feature (648)..(648): n is a, c, g, or t
  misc_feature (651)..(651): n is a, c, g, or t
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaataagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtngccnacngtngactaagtagccaaccgtggactagtagccaaccgtggactagtagccaaccgtggactaggacaaccgtggactagt

SEQ ID NO: 310633 - DNA, 782 bp, Homo sapiens
  misc_feature (491)..(491): n is a, c, g, or t
  misc_feature (693)..(693): n is a, c, g, or t
  misc_feature (747)..(747): n is a, c, g, or t
  misc_feature (759)..(760): n is a, c, g, or t
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaataagcattcctcgcnacagctgttgcgaggaatgctgagtgttcctgcatgtaagaattaagaccaagggaggggagagagaaacccacacataaacaatgcactaaagatcactgaactgtttaaacatttccacttgccagtttaatttcttgaagactgttgcttgtttggaatgtttcttgtcactgattttaaggttgcatctggaaaagantaaaggcttcagtcccctcccaccaccagaaatgaacaaaagcattttacctanaaatacacagcnnatgtactcagcattcctcgcaa

SEQ ID NO: 310634 - DNA, 565 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatatgccaagccaggcgaaaccccatcgctacaatgaaggttcacaatgtccaacagctcaagaaatacttagagacctgagcagctcgg

SEQ ID NO: 310635 - DNA, 1114 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagctggagtgcagtggcactatctcggctcactgcaacctccgtctcccaggttcaagcgattctcctgcctcagcttcccgggtagctgggactacaggtgcgcgccaacactctgtctaatttttgtatttttagtagagacggggtttcaccatgctggccaggctggtctccaactcccgacctcaggcgattctcccgcctcggcctcataaacctgtttcgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggccttggtatacgacccagagataacacgatgcgtatttcagttttgcaaagaaggggtccggtctctgtgccagctctataatcgtttcgctacgattccactgaaactcttcgatcaagctactttatgtaaatcacttcactcgtcttaccaggaataaacttggatcatatcgtccagctcatctggcataactgtggatcttctcacgacaattactggacacattaagggtgtctgtcagatattcatattgacccaa

SEQ ID NO: 310636 - DNA, 634 bp, Homo sapiens
  misc_feature (546)..(546): n is a, c, g, or t
  misc_feature (550)..(550): n is a, c, g, or t
  misc_feature (553)..(553): n is a, c, g, or t
  misc_feature (556)..(556): n is a, c, g, or t
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaataaccgtggactagtagccaaccgtggactagtagccaaccgtggactagtagccaaccgtggactagtngccnacngtngactaagtagccaaccgtggactagtagccaaccgtggactagtagccaaccgtggactaggacaaccgtggactagt

SEQ ID NO: 310637 - DNA, 756 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatactggagtgcagtggcacaatctcggctcactgcaacctccgcctcccgggttcaagcgattctccttgctcagcctccaaagtagctgggattacaggcatgcactaccacgcccagctaatttttgtatttttagtagaaacagggcttcaccatgttggccaggctggtctcaaactcctgacctcaagtgatccacctgcctcggcctcccaaagtgctgggattacaggcgtgagccactgcgccccacctaaactcaaatcttaagtggaata

SEQ ID NO: 310638 - DNA, 584 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatacaggctggagtgcagtggcacgatttcagctcactgcaacctccgtctcccaggttcaagcgattctcctgcctcagcctcctgagtagctgggattacaggcata

SEQ ID NO: 310639 - DNA, 577 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaataagccaccagcgctgagccatacagccgtgtgtatgcttcatcttcctgcagtatggactcattggcaagtagtcttgatgaaggagatacaacttcccc

SEQ ID NO: 310640 - DNA, 538 bp, Homo sapiens
tttacttaatattgggcataatcgtatcattcaagattaagtctgggttatttctttgataagaactgaatgtggccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatacacaacccatgccccaacccacgcggcccaaaaccaatgcccaaacccaggcgcccaaaa

SEQ ID NO: 310641 - DNA, 527 bp, Homo sapiens
  misc_feature (439)..(439): n is a, c, g, or t
  misc_feature (443)..(443): n is a, c, g, or t
  misc_feature (446)..(446): n is a, c, g, or t
  misc_feature (449)..(449): n is a, c, g, or t
ggtccacttatcacggttggctgcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaataagccaaccgtggactagtagccaaccgtggactagtagccaaccgtggactagtagccaaccgtggactagtagccaaccgtggactagtagccaaccgtggactagtagccaaccgtggactagtagccaaccgtggactagtagccaaccgtggactagtngccnacngtngactaagtagccaaccgtggactagtagccaaccgtggactagtagccaaccgtggactaggacaaccgtggactagt

SEQ ID NO: 310642 - DNA, 684 bp, Homo sapiens
  misc_feature (528)..(528): n is a, c, g, or t
  misc_feature (576)..(576): n is a, c, g, or t
  misc_feature (582)..(582): n is a, c, g, or t
gcagtggcaccatctcagctcactgcaacctctgcctcccaggttcaagcgattctcgtgcctcagcctcccaagtagctgggattacaggtgactgccaccatgcccggctaatttttgtatttttagtagatacgaggttcacggtgttggccaggctgctctcgaactcctaacctcaggtgatccacctgccttggcctcccaatgtgctcagattacaggtgtgagccacggcacccagccaaaccctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310643 - DNA, 655 bp, Homo sapiens
  misc_feature (499)..(499): n is a, c, g, or t
  misc_feature (547)..(547): n is a, c, g, or t
  misc_feature (553)..(553): n is a, c, g, or t
gcgccagcatgcgcggataattatgtatttatagtagagacagtgtttctccatgttggtcaggctgatctcaaactcccaatctcaggtgatctacctgcctcggcctcccaaagtgctcggattacaggtgcgaaccaccacgcccagcccgaaacacatttattgttcgtgcattgtattgtgttcgagacagggtctcgctcttttgcccatgctggaatgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310644 - DNA, 511 bp, Homo sapiens
  misc_feature (355)..(355): n is a, c, g, or t
  misc_feature (403)..(403): n is a, c, g, or t
  misc_feature (409)..(409): n is a, c, g, or t
attaggaagtgcagcgcggtgagcacatagcctgcgcacaggcgcgatcccactactgatcagcacgggagttttgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctgtctctactaaaaatacaaaaaattagccgggcgtggtggcacgtgcctgtagtcccagctactcnggaggctgaggcaggagaatcgcttgaacccgggaggcagaggttgcngtgagncgagattgcaccactgcactccagcctgggtgacagagtaagacactagatagatagatagatagatagatagatagatagatagatagatagaaccgacag

SEQ ID NO: 310645 - DNA, 422 bp, Homo sapiens
actctagagcatcccctggatcgagagctgctggtcaggtcggtaaggaggcagagatgtcgggccgggcgactcacgcatgctatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagacccctaggcaacctggtggtcccccgctcccgggaggtcaccatattgatgccgaacttagtgcggacacccgatcggcatagcgcactacagcccagaactcctgggctcaagcgatcctcccacctcagcctcccgagtagctgggactacaggcacgcgccaccacgcccgg

SEQ ID NO: 310646 - DNA, 501 bp, Homo sapiens
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctactcgctatgttgcccaggctggagtgcagtggctattcacaggcgcgatcccactactgatcagcacgggagtttagacctgctccgtttccgacctgggccgggtcgagc

SEQ ID NO: 310647 - DNA, 955 bp, Homo sapiens
  misc_feature (462)..(462): n is a, c, g, or t
  misc_feature (582)..(582): n is a, c, g, or t
  misc_feature (633)..(634): n is a, c, g, or t
  misc_feature (664)..(664): n is a, c, g, or t
  misc_feature (670)..(670): n is a, c, g, or t
  misc_feature (692)..(692): n is a, c, g, or t
  misc_feature (734)..(734): n is a, c, g, or t
  misc_feature (771)..(771): n is a, c, g, or t
  misc_feature (932)..(932): n is a, c, g, or t
  misc_feature (936)..(936): n is a, c, g, or t
  misc_feature (942)..(942): n is a, c, g, or t
  misc_feature (946)..(946): n is a, c, g, or t
gagcagatacacacagtagacagaaattcaatgttaaacactaaaataatgtataaaagaggtaatgtagccgggcgcagtggctcacgcctgtaatcccagcactttgggaggccgaggcgggtggatcacgaggtcaggagatcgagaccatcctggctaacatggtgaaaccccgtctctactaaaaatacaaaaaattagccgggcgtggtggcggcgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaactatcacgaaaaaaactctacctctctatactaatctccctacaaatctccttaattataacattcacagncacagaactaatcatattttatatcttcttcgaaacacacttatccccaccttggctatcatcacccgatgaggcaaccagccagaacgcctgaacgcaggcacatacttcctattctanaccctagtaggctcccttcccctactcatcgcactaatttacactcacaanncctaggctcactaaacattctactactcancctcantgcccaagaactatcaaactcntgagccaacaacttaatatgactagcttacacaatagctttnatagtaaaaatacctctttacggactccacttatganccctaaagccatgtcgaagcccccatcgctgggtcaaatagtactttgccgcagtactcttgaaactaggcggctatggtataatacgcctcaactcattctcaacccctgacaaacacatagctacccttcttgtactatcctatgaggcataattatancagntccatntggntagaaaaca

SEQ ID NO: 310648 - DNA, 520 bp, Homo sapiens
actgtgcgcaagcggggggcgggcgcaggccgcggtctcgctccgctcccctttgttctctcccattgtgtggcacttcctcctcaggcgcttcttctctgcaccctggcagcccgtggggagttcgggaaggggccctggatgccttttctgcttgtttttgagtacgtgaggacctccccggcaccgcctcgcgcgggtccctgccccgtgcccaggcggaggcggggtggccactgtccttccttcccgctccgcgccctcggcggcttccccgcggccccctgcgccgcgccccctccaggaggcgtcctgaccccgcactccggcctttcacctcccgaccgtcagcctcagggccgccgcggcgacgcgcgaccccttccctctgaggggcgcgggctccggacgcgccgggctctgccaggcatctagtggagggtcggaggtcggcgaccagcccgagcccagccgtcccgggagctggcgcgagtgtcgccacgaccctccctgtcccttg

SEQ ID NO: 310649 - DNA, 4680 bp, Homo sapiens
gggggaagagaagcgatcgcgagagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310650 - DNA, 4326 bp, Homo sapiens
actgtgcgcaagcggggggcgggcgcaggccgcggtctcgctccgctcccctttgttctctcccattgtgtggcacttcctcctcaggcgcttcttctctgcaccctggcagcccgtggggagttcgggaaggggccctggatgccttttctgcttgtttttgattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310651 - DNA, 4528 bp, Homo sapiens
actgtgcgcaagcggggggcgggcgcaggccgcggtctcgctccgctcccctttgttctctcccattgtgtggcacttcctcctcaggcgcttcttctctgcaccctggcagcccgtggggagttcgggaaggggccctggatgccttttctgcttgtttttgattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310652 - DNA, 4556 bp, Homo sapiens
gggggaagagaagcgatcgcgagagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310653 - DNA, 4051 bp, Homo sapiens
gagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310654 - DNA, 3239 bp, Homo sapiens
tcacacacagacacacacgcacgcacacacacacacacacccacacacacacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttcctttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310655 - DNA, 3477 bp, Homo sapiens
gggggaagagaagcgatcgcgagagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtcggacacttggggcatttcgaggtctggccctaagaatttactttctccttttccttttttctatttagaccaaaaaaaacaaaaacaaaaacaaaaaaaaaaaaacaaaattattacaaaatcgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctatgtttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagcccagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaa

SEQ ID NO: 310656 - DNA, 1958 bp, Homo sapiens
gggggaagagaagcgatcgcgagagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctaggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagttgtacactctgtttattgtcctttgtgtgtgagctcacagactgtgctgcttaggatgctgtcgggatctc

SEQ ID NO: 310657 - DNA, 429 bp, Homo sapiens
  misc_feature (23)..(23): n is a, c, g, or t
  misc_feature (37)..(37): n is a, c, g, or t
  misc_feature (39)..(39): n is a, c, g, or t
  misc_feature (44)..(44): n is a, c, g, or t
cacataccatggtcaaccattcnacccaaaaaccacncngttangggcaacgagccagcttttcaatgctggagccaagcttgcacattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaatt

SEQ ID NO: 310658 - DNA, 514 bp, Homo sapiens
acctgtaggcaggtggagaggggatgggggaggtctcaggtcctcttgctcacccatcagctgtgtagtgtctgaagtgattaaggagcttggggaggcctcccaggctggtctgctccactggccctcagaaagacttgtcgcctcgccgagcctcagtgttctcatctgaagaatagagtgggcaaggcctttctcctacacactcagagccctgaatgggaagaaatgggttccatgtgcagcaagccaggagagatttaggcaacgagaacctccagttctgtcttagggttcccagctttctccttgtcctgagggagccgctgagcctgtgggagatgaggggtgcccattccccagtgcttctcaccctcccccacctgccctcctggggtacctttgtctgccacttgcatcctattggaagctgtccccaagtgcgtgttaggcaggtggcaggtgctggagcagagtgcaccaccctccggcgatcactgtgagttggggtaag

SEQ ID NO: 310659 - DNA, 462 bp, Homo sapiens
acctgtaggcaggtggagaggggatgggggaggtctcaggtcctcttgctcacccatcagctgtgtagtgtctgaagtgattaaggagcttggggagaatgctggagccaagcttgcacattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaatt

SEQ ID NO: 310660 - DNA, 416 bp, Homo sapiens
cagagaatacgatcaacccacaacaatccgaacaccaaaccaaaaaactttaatgctggagccaagcttgcacattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaatt

SEQ ID NO: 310661 - DNA, 436 bp, Homo sapiens
attcccggtatgttgatttatttgatcccgcccggcacatttggttgttatagattggtgtggggctaatgaatgctggagccaagcttgcacattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaatt

SEQ ID NO: 310662 - DNA, 525 bp, Homo sapiens
acctgtaggcaggtggagaggggatgggggaggtctcaggtcctcttgctcacccatcagctgtgtagtgtctgaagtgattaaggagcttggggagaatgctggagccaagcttgcacattctaggcagccatttggaagattcttctctgcgcatgaccagctgaaaaggaaaaaccccgaaacattggcactgtgatttctccatgtgaacagtttagttcgccgaggtggacatgcctcattcatgcttatggagtgaccgaccagcctttagtgacaccccctgaaatgtgagtcatccatgggtcactagtcattggagaagagccccttatacaaaacttggagctcagaccacaaacaacaacaacaatccaaaaaataaaaaaatgaaaaattaggagcagagactaaatggaaagatggaaatattaaaataaaaatattattttaaaaattaatatgtattaaaattttatttaaagtaaaaataaataaaataaaaaaattaatattaattaa

SEQ ID NO: 310663 - DNA, 284 bp, Homo sapiens
ggtgagaaactgcctcccatcatcaatatttattgagcatttacagtgtactaggcacaatagaacatacagaaaacatgtccctgctcttgaggagcttacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgga

SEQ ID NO: 310664 - DNA, 1346 bp, Homo sapiens
  misc_feature (6)..(6): n is a, c, g, or t
  misc_feature (10)..(10): n is a, c, g, or t
  misc_feature (24)..(24): n is a, c, g, or t
  misc_feature (46)..(46): n is a, c, g, or t
ggtcantagnctcgctgtcagtgnagcgtcttcgtggagcccgggntgagactcaaggggcaaaccacactcctgtcatatccgcccatcaaactcgcagcaccaccacaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataa

SEQ ID NO: 310665 - DNA, 934 bp, Homo sapiens
  misc_feature (64)..(64): n is a, c, g, or t
  misc_feature (755)..(755): n is a, c, g, or t
  misc_feature (757)..(757): n is a, c, g, or t
  misc_feature (762)..(762): n is a, c, g, or t
  misc_feature (772)..(772): n is a, c, g, or t
  misc_feature (774)..(774): n is a, c, g, or t
  misc_feature (779)..(780): n is a, c, g, or t
  misc_feature (782)..(782): n is a, c, g, or t
  misc_feature (791)..(791): n is a, c, g, or t
  misc_feature (798)..(798): n is a, c, g, or t
  misc_feature (807)..(807): n is a, c, g, or t
  misc_feature (811)..(812): n is a, c, g, or t
  misc_feature (817)..(817): n is a, c, g, or t
  misc_feature (820)..(820): n is a, c, g, or t
  misc_feature (827)..(827): n is a, c, g, or t
  misc_feature (832)..(832): n is a, c, g, or t
cggttggacgacgtcgtagaggatcccccactatgttgattgttgccgctggtgatgacaaganagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaacananggtcnttggtccgcncnaggtnnantggggactnaggttgngcctcaagngggnnatttnccnggttccnttacngtttccggaccccttgcccgttaccggacaggctttacagtgccctctggatgggacccccacgggcgcggctaggcactgttagtgccaacaaagaaggtt

SEQ ID NO: 310666 - DNA, 492 bp, Homo sapiens
cgcatcgacgccccggcgccgatcggtgctcgctcccccgtcctgcccccgggggtgggtagggcgcccacacgcgagatccctggggatctccctgtcgccggctcccgaaggtggacgaggcatggccggggcgccgccggccgcgatccatccccaccctcgcctgggacctagagctgaatttcctgggctccgcggtgggaggaaggacttgaattttcctggtgggggtgggggatgggtctgactttttttgctccttgtgaacgggcgggggaggtgtggacgggggctgcaagtccaggtcggggtagagaacagggtggtgagcccgcagtcggctcccgtgcttgatggactagaactggagggtccctgcgctcggtttggggacgcatatcctgctttgggggcgggtgagcctgagcatagccgctggtggcccgctcggctgggtgtggctctcgtcccctcccccacctgcagctg

SEQ ID NO: 310667 - DNA, 1010 bp, Homo sapiens
gattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctccaaagtgggattgattacaggtgtgagccaccgtgcccagcgttagatgttcttaaaacactgattccttctaggattattttgctagcattcatgattcggagggagacaattctctgaacctgatttaatttggcagtttttattctcacttcctgctagccctttcacccagttgattaaaaaaaaaaagttttagaacagaacagatggggctttctatcagcattgtttagtgtaggtatcttttgttttggggtaaatatcagggagcagctactcttttaacaggaattatattaataaagttttaggctggctttaacagttcttgaacatcaggaacatcttgcttggccagatttcttgttgattaaaagtgcagatttgccatctattaatggaaaatgcgttaagtgattaggcacaagcctgcttatagatgaccttatttatagaacatatgttcacagcttaaaatcttattctgttaggccacattgcatagaaaggtaataatttaaagtcaaaatgtctaaaagacttaataaattagttcttgacacctcctaatcattagcatttctggtggagcacttttctaattggttgaaagcaagtgaggaaattgcaaatcaaagaatggaagccactccggccacaagggggagtaagagattaaatctatgggcccctaatgtgtgacagattatgggcttcttgcatgatttctttttaaaattttaagagatctaggatttatacaaggcccagtgtctctacagaataaaaattataggaaaattatctctgcataagagaattgtacaagaccagaaatttgaactacactatg

SEQ ID NO: 310668 - DNA, 939 bp, Homo sapiens
catgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcaggtaagggttaaatgggtgcggtgagtcctgcccgcagtgtagaggcgaggccttggagcactcgttactgtgtgagaaaccttatccacttcctcttgtaccgaagtgattggggagagaatcctttgtactggcttaaatcattttttgttagaagcagaaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttataaattaagtacttccaatgtgatatattctagtactcacagtaagagttgaagtgtcatga

SEQ ID NO: 310669 - DNA, 2712 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310670 - DNA, 2613 bp, Homo sapiens
cttctattgtgaaactgaaaggagacttgctctctgcttgtgaagcatggggatagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310671 - DNA, 2671 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgga

SEQ ID NO: 310672 - DNA, 2523 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggag

SEQ ID NO: 310673 - DNA, 3099 bp, Homo sapiens
  misc_feature (3099)..(3099): n is a, c, g, or t
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaaaagacaagaaaacaagaaaacgacacacacacacttgtcgccagcaacagaccacacaaacagctcagagaccaatcggttgggcccgcggcacagaggaatcgtgacactgggcaagaggagacaaagagaccggacagaacacggggagaccacacaaaaaaaccggggggaccagcggtagacaaccccacagggggtcagcaggcaacggagcgccacacgagccagaggctaaatacgcccctgcctgctgagaggaccaagcacaccgacgagaagacaaagcagcacaccgcgcagcagcacacacgacacgagcactgaaccaccgacgagacgaacaaagaaccagcacggacaagcagcaagcgaccacagacgaacaaacgcagaactagaagcacagacgcaccacagagan

SEQ ID NO: 310674 - DNA, 2724 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaaaaaaaagtcgacgcggccgcgaatttagtagtagtagtaggcggccgct

SEQ ID NO: 310675 - DNA, 2777 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaacaacaaacacacaacaacacaacaaacaacacaacacaggccggccccccccccccccccccccccccccccccccccaccccccccgccccctcctcaccacgc

SEQ ID NO: 310676 - DNA, 2701 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaataaaaaaacatagccgaataaacaac

SEQ ID NO: 310677 - DNA, 2836 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggacaaaaccacaccacaagacaacaacacaaaacacacactgcgggcgcgcacggagccccagagaaagccactacaaaacaccagcgggcggccccgcggccacagccggaacgcgtaacaacgggcgccacacacgggcccccagggagaccgcgggcacaacaa

SEQ ID NO: 310678 - DNA, 2745 bp, Homo sapiens
  misc_feature (2629)..(2629): n is a, c, g, or t
  misc_feature (2638)..(2639): n is a, c, g, or t
  misc_feature (2643)..(2643): n is a, c, g, or t
  misc_feature (2645)..(2645): n is a, c, g, or t
  misc_feature (2647)..(2647): n is a, c, g, or t
  misc_feature (2650)..(2650): n is a, c, g, or t
  misc_feature (2659)..(2659): n is a, c, g, or t
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggttgatattngccaatttnnttcntnanggnggggaacanaaaaaaaacgacaaaaaaacaaaaaaacaccggcttttggggaaaaagggggttttcctttaggccctgtatttctagcaaaaaag

SEQ ID NO: 310679 - DNA, 2987 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaaaaaaaaaaaaaaaaaaaaaaaatttttggggccggcttcggcctcgaaaaaagttttttaagaacctatcttgttgggggcgcgcgggcccccagtgtagttaatgtggcacattggtgccctacaagctcgtgtcccaagggagatcccggtcactgggacaggttgttggttttcttcaccaattaaaaaaacgccggggggaacccgggtttttttggaacaaatccagatgggctgtccggaggcatacaagggttctatcaacccgggatcccaggcgactcgatatccaattagcggcctctgtgc

SEQ ID NO: 310680 - DNA, 2650 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcgctcgtaggatcagactcctggtagagtc

SEQ ID NO: 310681 - DNA, 2447 bp, Homo sapiens
ctgactagaggacccgtgatgttatcctgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310682 - DNA, 3105 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacaggagaaagacaaaatgaagaaaccaaaagaaacaaaaaaagatcggggcgcgcgcgacgcgaagcgcaccagtaaaaatacctgcttgtacacaacctatccagcttagtgcgaggcgccggcggcactcacagagaatggcacgggcgcaagctaggggacgcagctagttgccaccacaagaacactctggggcaaggacgcagaggagtcgcggtgtgcacaccacaggaagacaagcccccgggggcgcgcagagagctcgtctatacaccccatagcgagggcacgggggtggccatggggctgttatacacacgggtgccaaagaaggtcgaacataaagttgacccccccgcgggggtgaccatggtctaaatgcagactccaagaagcgaattcgaatggacagttacacccagttactgcaatgctgtgtctgaccttcactcagcatctgagatagacatgagtgtccaaaggccagagatgggtctaggtgaccgaaaacgaagtaatgctctctagcaagactgt

SEQ ID NO: 310683 - DNA, 2406 bp, Homo sapiens
ggagtatcatatcgtcgaaccaggcgctcgctgtgtactagtgccgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310684 - DNA, 2568 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataaggtaaggctcccggaggtaaggaga

SEQ ID NO: 310685 - DNA, 2742 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggagaaaaaaaaaaaaaaaaaaaaaaaaaaaaaaaaaaaaaaaaaaaaaaaaaaaaaaaaacaaaaaaaaaaaaaaaaaaacaacaaaaaaaaacaacaaacaaaaacaaaaaaaacacaacaaacacacaacaacacaacaaacaacacaacacaggccggccccccccccccccccccccccccccccccccccaccccccccgccccctcctcaccacgc

SEQ ID NO: 310686 - DNA, 2566 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggagcgtggaggattccttttttttggggtggggtttttgggggggc

SEQ ID NO: 310687 - DNA, 2593 bp, Homo sapiens
  misc_feature (2406)..(2406): n is a, c, g, or t
  misc_feature (2422)..(2422): n is a, c, g, or t
  misc_feature (2427)..(2428): n is a, c, g, or t
  misc_feature (2431)..(2431): n is a, c, g, or t
  misc_feature (2440)..(2440): n is a, c, g, or t
  misc_feature (2442)..(2443): n is a, c, g, or t
  misc_feature (2446)..(2446): n is a, c, g, or t
  misc_feature (2448)..(2448): n is a, c, g, or t
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaagggaaaaccaaaaaangctttaaaagggtttnttttnnagnaggcctcanannggnangtttggtggccatggcagaacggatgcaaattgagggggggttagtaagggaagaccccaacgcgggggttactccaaggaagcgtatgcacatttagggggaaaaaaatgggctattgggggtgtgtttatcctttttattttg

SEQ ID NO: 310688 - DNA, 2600 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaatttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgga

SEQ ID NO: 310689 - DNA, 2658 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310690 - DNA, 2649 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccatggccactcaataccggtattgagtggccatgtgacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatgcaccaacatcacagcacgcatgcccagtcacatgccgggaccgg

SEQ ID NO: 310691 - DNA, 2232 bp, Homo sapiens
ctcctcaaggagaactaaaaaccactgcttagcgaaataaaagaggactcatacaaatggaagaacattccacgctcatggataggaagaaatcaatattgttaaaatgtctttaccacccccaagcaaaccgcagatacagtgcaactcctctcaaaataccgatgaacatacttgacatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310692 - DNA, 2659 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaagtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310693 - DNA, 2264 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctcgaacctatcagggatcctctagaacagc

SEQ ID NO: 310694 - DNA, 2359 bp, Homo sapiens
  misc_feature (2250)..(2250): n is a, c, g, or t
  misc_feature (2273)..(2273): n is a, c, g, or t
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctattatgggaaactctcttagtgagagacgggtttctccttaaacctaatatcgaggtggctggtgncttaaaactccttttccctatcnaaagggggggttcacacagcttaaatcctctgggacaccagcaaggtttcatccccgcaggtttatcacaccaacgggggactcta

SEQ ID NO: 310695 - DNA, 2193 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatccccatgccgccgggattcttcaaaagtcgccc

SEQ ID NO: 310696 - DNA, 2159 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccaaagttaggctccaaagcctgatagggtccgagtcga

SEQ ID NO: 310697 - DNA, 2417 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccaatgggtcaccagtcgtacgactggtgcccatgaaatttcccgaggcactaattttgactttcagaaagtgggagggctgatatgtaaggcaagttattcaggaatgaggagggctgacagttgtaactcagggtggttggcaactgcctacgttagtcccaggtttcccataaaactctgtagaggccatttacatttcgaaaatcctgtaattacaccttactgtatcatgccctagtagtttcacaaacttagatattcacaaaaatgttgtggaatatattcctggggaat

SEQ ID NO: 310698 - DNA, 2366 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgga

SEQ ID NO: 310699 - DNA, 2121 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattgggttaccctcggtttgtcacaactcttatgggtgccggtctgggccgtgatcttgggcaccagtgtaggcccggtcttgggtgtccttc

SEQ ID NO: 310700 - DNA, 2179 bp, Homo sapiens
ctcctcaaggagaactaaaaaccactgcttagcgaaataaaagaggactcatacaaatggaagaacattccacgctcatggataggaagaaatcaatattgttaaaatgtctttaccacccccaagcaaaccgcagatacagtgcaactcctctcaaaataccgatgaacatacttgacatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaagtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310701 - DNA, 1960 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaaaaaaacatagataagaaaaaaaaattgtggcgggggcaggcctaaagaagaagttttaaaaccacttccctggggccgggccccaagtggtatattaaacactggggccaaagcgtggtcccagagaaaactcggcccagcgataggggtgtagttcccccataaaagagccgcggcggcgccggggtttgaaacacccaggggtcgcggcctacggggctaccagggccgcgcgagccgccgcggagggcg

SEQ ID NO: 310702 - DNA, 1549 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatgga

SEQ ID NO: 310703 - DNA, 1529 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtgga

SEQ ID NO: 310704 - DNA, 1587 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggaaaaaaaaatatacaatattcaactgttcaacaataaaa

SEQ ID NO: 310705 - DNA, 1765 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggaaaaaaatcaaaaagctttggactcacaattttaccaaaaataaagctattccttagctacaaagataccttcggggggggccccgtcccactttgcctttatggtgccatattcaaatccctggcggcttttacaacgttggaatgtgaccctggggttcccaatttaatggcttggagctccccctttgcccagtggcgtatatacggcggccct

SEQ ID NO: 310706 - DNA, 1768 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggaaaaaaaaaaaaaaaaaaaaaaaaaaaaaaaaaaaaaaaaaaaaaaaaaaaaaaaaaacaaaaaaaaaaaaaaaaaaacaacaaaaaaaaacaacaaacaaaaacaaaaaaaacacaacaaacacacaacaacacaacaaacaacacaacacaggccggccccccccccccccccccccccccccccccccccaccccccccgccccctcctcaccacgc

SEQ ID NO: 310707 - DNA, 2472 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggaaacaaaaaaaaaaaaaaaaaaacaacaaaaaaaaacaacaaacaaaaacaaaaaaaacaaaaaaaaaaaaaaaaaaaaaaaaaagcgagagccacagaaaaaaaaaaaaaacacaacaagagagagagaacaagaaagaaatggagcgcaccaacatatattcgtacagaggaggggcacaccacatagagtgatgaaaataaataacacgacaagagcggcagcccgtataatataagactacatggagagagacaaacgacggaagacggacaataggaaaagaagaagacacaactcatgctggggtgaacgaaaaaaaaatgtagacacccccacaagatataaagaaccccccacatgccaaaaaaacacaccaagacgaacgaaagcacatacggcccaaaacacacaagcgaaaatatactgtcgcgcaggaacaaaacaagtacagaccaccgaagaacagagagaagaaaccaaaaagatcaaaaacaggcaccgacgaaaaatataccgaaaaaataacaagcaaaaaatcagaaacccaacaaaaagacaagaaaaaacaaagcaaacaacagaagcgcacacgatcagcaccaccactgccaacacgacgatcaaacagaaaagagaaacggacagaccaaagaccacaacaaccacccacagacacaaacacagaaaaagacagccacgcaacggacacacccgacaacagaaggaagaaaagaggagaaaaaaagagacggaaaaaagagaaaggaacagagaaaaaacggaccaaaagaggagcagcaagcgcgacaagacaaagtaaaaagaaaagcaagacacaaagacagcaggagaaagaagagagaggagaagagacaagaagagaaagcagacgaagccgcaagaggaggacgcaacgcata

SEQ ID NO: 310708 - DNA, 1487 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtaaaaatagttaacagggaaataacttgagatgatggctagctttgtttaatgtcttatgtgtaagtggtataaagtttttt

SEQ ID NO: 310709 - DNA, 1506 bp, Homo sapiens
  misc_feature (1431)..(1431): n is a, c, g, or t
  misc_feature (1475)..(1475): n is a, c, g, or t
  misc_feature (1482)..(1482): n is a, c, g, or t
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttttttgatacttgcctaacatgcatgtgctgtacttaaatagtacaggaatacttgnatatgctacttgttaagctagaattcagacatcaacatatgtanacctgtntaatcagtagggataaattagatg

SEQ ID NO: 310710 - DNA, 1746 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctg

SEQ ID NO: 310711 - DNA, 1332 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgaagtagttatactcctgggcttaacgtagtttacgggcctggggacgaaatccattactagaaaacgcttttacactgtaaaaacaaaaataaaaaagaaacctggaaaagggatagggaatacaggaacgtggggcctttggggggtaccggacgctcgaattccggtacaccag

SEQ ID NO: 310712 - DNA, 1158 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagtctaccatgcagcgctacggtaccga

SEQ ID NO: 310713 - DNA, 1145 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaaaaaaaagtcgacgcggccgcgaatttagtagtagtagtaggcggccgct

SEQ ID NO: 310714 - DNA, 653 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacagaaaaataaatgtccctgccaacgtca

SEQ ID NO: 310715 - DNA, 1020 bp, Homo sapiens
gatctagagatccccgtgtatatcgatgccactaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataa

SEQ ID NO: 310716 - DNA, 545 bp, Homo sapiens
atcccacacattatgacaaattctgttttaatttccatttagttcaaagtctttttaatatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggaaaaaaaaaaagtcgacgcggccgcgaatttagtagtagtagtaggcggccgct

SEQ ID NO: 310717 - DNA, 245 bp, Homo sapiens
gaactttatctgattctttgcaccatctcccagcatctagactagtgtctggcacccatgaatattaggtacccagaaatgttaacatgaattaattttccaaaagtggttaaattagtatatctgaagattaacttactgtagtgagattttaatcatgatctagcttaagacgagttttgaaggcaagaactgtctttttttaggagtttttgtatatcgtttggtatttatttatttatttt

SEQ ID NO: 310718 - DNA, 3654 bp, Homo sapiens
ccctgtgaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaagtgtacctgtaaatgtcctgaatccagcattgttgagctgtcatcaacattcttgtgtctgttttactgttacaatattaggtgaatatggaagtaaaggcattccacaggatcatcatttaaaaaaaaagaattctggtcctgttttctaaaaaaaaaaaactgttgtagaaattcttaatttggatctatttattagtcagagtttcagctttcttcagctgccagtgtgttactcatctttatcctaaaaatctggaatcagagatttttgtttgttcacatatgattctcttagacacttttatatttgaaaaaattaaaatctttctttggggaaaaattcttggttattctgccataacagattatgtattaacttgtagattcagtggttcaatacctgtttagttgcttgctaatatttccagaaggatttcttgtattggtgaaagacggttggggatggggggatttttttgttcttgttgtacccttgttttgaaactagaaatctgtcctgtggcatgcaaaagaaagcaaattatttttaaaagaaaaaaaccaaagtacttttggtgtcattattccatcttctccataagtggagaaatgaaaagtaagaacagctcatcttcaaagtttttactagaaattcagccgaaaagaagagaaatgaagaaatacttctggatccaaaggttcgtcactggatcagccttaagaaagtctctatgtgtgctaatagaccagtatctcccttgtttgttcccatgccagatgctgtcttttcatacagagattaactagtgtctgtacagaaaatggtctttccaga

SEQ ID NO: 310719 - DNA, 1644 bp, Homo sapiens
gaaaattttatttcagagaaggtgtgtgtgtttcttatagtggtcaaaattttgaaaggcacctttttagaatgtttgccgatttatgagaagaccaaatggcgttcataaagcatcattgaaagctctttctacatgaaacacagatggtcttcctctttaggattttcatatcctttgtatgtgagaagagagaaagaagttggacatccatggtttgtatgtctggctggtgtttgagggatcgatcacttatttgttgataagtgaaagtctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagagaaacagattcttgcaagtgaaagtccactaagcacagcaatcagataagcaataaagaatggggatgtggacaggctactagatgaacgcgtgagcttcccgaagttatgacctgtggacgacctctgtcgccaccgcaccctccacaacgggcttcttttcacccctgtttgttttgcctgaaaaccccgctcacatcgaatcgttcggaacagggccaaatggcttatagttgatcgtcggtcgggtaaacagagtctctctctttgtttccgaatatctatttttctcttatcaccacacgcacgacaaaccctcagtaccagtagcacacacgcaccagcacgacctatcgactcacacacgacatcactaacctagtcgacagctccagtcgacagtgcgtaggactcatacaaccaaccacgctatccagaggcagaagcacaactaggcccgacgcgcacgaaggcgcgagtggggacgcggaggcagccgagacgcgaggagcgccgagacgccaatagagagaaggtgagagccagcgcgcacgagggccgaggagacgacacgtcacagtggaaaccggagccaaggccgagaaggcaagcgcgagccggacaacgctgacaacaacgaccacacgcaagcgacacaccggagactgcgcgagagcacacgacacaggagcagaacatgcagcagcgcaggcgagcagacggagagagagagcgagcagcgaacgaacaaacggccaggaggccacacacgagacgccgaagcaaacacccacaggcacaagccaagcgagcagagagcaggggaacgagacggagcagcacgaacgaacagagccacaggcacacaaccgaagccgcacagcgcgagcgcagagcagcgcaacgcagacacccacagcacaccgagacgaaacaaacggcgagacgcctagcagtacgcgcggcgagagcacgcacacgcgagcgagcgcgcgctcgacaccagaccgaacgacaggtcacagagcggagggaccagacggaagccagcacgcagccaccac

SEQ ID NO: 310720 - DNA, 2816 bp, Homo sapiens
ccctgtgaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310721 - DNA, 2397 bp, Homo sapiens
gcgccgcgcgggccaggtcccggctcccgcctgcccgcgcgcgcgccacttcggcttggtgaaagtcaccgcagagaaaggaccgtcagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcacagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310722 - DNA, 2950 bp, Homo sapiens
ccctgtgaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaaaaaaaaacaaaaaaaaaaaaaaaaatctccagggggggcccgggaccaaattcgccctatggggggggggtttacaatccactggccgccattttacaacgtcttagaatggaaaaaccctggggttacccaac

SEQ ID NO: 310723 - DNA, 1805 bp, Homo sapiens
ggggccgcctactactactactgctcgaattcaagcttctaacgatgtacggggccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310724 - DNA, 2672 bp, Homo sapiens
ccctgtgaggctcggagcccgggtgtcaggcgccacggcgcatgctccgcaatcatcttctttaccctggagctgctgctgctgctgctgcttttgcttttggggctgagtttaataagcgagcgagcgagcaagcgagcgcggggggaaaaaggcagagaatgtccgccatctaccctccgctcctgggcgcgctctcattcatagcagcctcttcatgaattacagctgagggggggcggaggaggggggggtaccacacaacaccccagcaaacctccgggcccccaggcatggctagctcgtgtgccgtgcaggtgaagctggagctggggcaccgcgcccaggtgaggaaaaaacccaccgtggagggcttcacccacgactggatggtgttcgtacgcggtccggagcacagtaacatacagcactttgtggagaaagtcgtcttccacttgcacgaaagctttcctaggccaaaaagagtgtgcaaagatccaccttacaaagtagaagaatctgggtatgctggtttcattttgccaattgaagtttattttaaaaacaaggaagaacctaggaaagtccgctttgattatgacttattcctgcatcttgaaggccatccaccagtgaatcacctccgctgtgaaaagctaactttcaacaaccccacagaggactttaggagaaagttgctgaaggcaggaggggaccctaataggagtattcataccagcagcagcagcagcagcagcagtagcagcagcagcagcagcagcagcagcagcagtagcagcagcagcagcagcagcagcagcagcagtagcagcagcagtagcagcagcagcagcagcagtagtaccagtttttcaaagcctcacaaattaatgaaggagcacaaggaaaaaccttctaaagactccagagaacataaaagtgccttcaaagaaccttccagggatcacaacaaatcttccaaagaatcctctaagaaacccaaagaaaataaaccactgaaagaagagaaaatagttcctaagatggccttcaaggaacctaaacccatgtcaaaagagccaaaaccagatagtaacttactcaccatcaccagtggacaagataagaaggctcctagtaaaaggccgcccatttcagattctgaagaactctcagccaaaaaaaggaaaaagagtagctcagaggctttatttaaaagtttttctagcgcaccaccactgatactcacttgttctgctgacaaaaaacagataaaagataaatctcatgtcaagatgggaaaggtcaaaattgaaagtgagacatcagagaagaagaaatcaacgttaccgccatttgatgatattgtggatcccaatgattcagatgtggaggagaatatatcctctaaatctgattctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310725 - DNA, 1509 bp, Homo sapiens
tctttcttttcaagaagatcattcttaacagctctccattccttgctgacacacatgaacttaggggcacttctgttttcctgagggctacaccgttttcttttgaaagagtctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310726 - DNA, 1630 bp, Homo sapiens
tctttcttttcaagaagatcattcttaacagctctccattccttgctgacacacatgaacttaggggcacttctgttttcctgagggctacaccgttttcttttgaaagagtgtggatctggaccctcactaacttgtctgtaggaagagaaaattgaagagagagaggaagaggctgaggagaagacctttaccggtgctgtcctgagctgccattgttgaaggacatccttctgaacaacccagtcctgccagctccagctccagctccagctccagcttcacaccatcccagaccaggcaacaaggtcctttgaggtctataatgaaagatctgcattctgatgacaatgaggaggaatcagatgaagtggaggataacgacaatgactctgaaatggagaggcctgtaaatagaggaggcagccgaagtcgcagagttagcttaagtgatggcagcgatagtgaaagcagttctgcttcttcacccctacatcacgaacctccaccacccttactaaaaaccaacaacaaccagattcttgaagtgaaaagtccaataaagcaaagcaaatcagataagcaaataaagaatggtgaatgtgacaaggcatacctagatgaactggtagagcttcacagaaggttaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310727 - DNA, 1042 bp, Homo sapiens
tggtggtcattccacaggacgaaggcatattcaatacactgccttattacataaccgaggaatgacattgagagaaagacacattctgcagcagatcgtgaaccttatagaagaaactggacactttcatatcacaaacacaacatttgattttgatctttgctcgctggacaaaaccacagtccgtaaactacagagttacctggaaacatctggaacatcctgaggatataacaactggatgcatcaagaactattgtgttttttttttttggttttttttttttttggttgtgattttttgttcttgttgtttatatgaaaacactcaaaatgatgcaaccaaaagggaaaaaataaaaatcaaacaaccttcagctttatttttctttaaagccagtcatcatctcttgataaaggagaggttaaagcaaaccagcctcagcggaccactcttctctccaaggaaatccccgggaagagttagcctggatagccttgaaaacaaacaaatcaaacacaacacaagaaaactcaaagaatgtgtatggtatcatgtatctctctgtggtggttcattccacaggacgaatgcatattcaacacactgccttattacataactgatctatttattatcgcatacagatattctaagtcgttgagggaatgacaccatcagacattataagtacttggtcccgtggatgctctttcaatgcagcacccttgccatcccaagcccagtgaccttactcgtataccgtgccactttccaccaactttttccaagtcctttaactcgttgcagtctgtattttccaccttttgtttttccagttccaggacacagattatcaactggggggaccaaatagccaccttgattttcttctttgtggtctttttcctgaaagttggggcccagtccttggctgtatccatgtaatgatcttggaccatggtagaaaatgcaccaaataggatcatatgaattgctgtctagccttagtcaataaacttgtaggacttttaaacaaaa

SEQ ID NO: 310728 - DNA, 456 bp, Homo sapiens
gtgagaacaatttctttgcttgctgtgtttctaatttttaaagataaactatatgtaaagtttatttactatgagtagtaatttcataggcaagatagcttctgggatattatgtaaggtaatgaaaaatggggtgagagggatggaacaaggaaaagccacaggaggttttgatgtatagaaaaattcaggaaaatcttacaattttagatgattaatgtgcatataacatgcattcatctaattaagaaaaaaatagagaaaaagttttaaaataggagccccagtgtgcatttgttctccagagtgatttaaagtaggaaaaaagatacccttctcctctgacttcagcacatttacaagtattttatctaccagtgaatttttaagtgcatgttaaagaaatagaagcattttttaactcatgattatcgtattaaataatttctcttattt

SEQ ID NO: 310729 - DNA, 525 bp, Homo sapiens
ttagttctacttttctgactcagcatttcagatctaagtaattcattttccaaggaaaataagattagagagaagaaggaaaatgtatagaaaagaaatgctatttggaaagcaaatgttactgtacatttcattcagtggatgcctttgtttaggtggctggttagctaagagatgcttgaaataaaatttaacacagcgttctctttgatccctagattcttgaagtgaaaagtccaataaagcaaagcaaatcagataagcaaataaagaatggtgaatgtgacaaggtaggtttctagtctgttactaggagggctccaacactgacaagccttccgtttctttgtgttgcccttgatcatccttgctggttctcctttcattttcttcatcaaagtgtccaagatgcccaaatgatgagtatttcatcccagtgctttgtagtttgttttccatgtgttgtttatatcttcagtattaagcttggccttatgctgtcatttgccatgatgcctacgttgc

SEQ ID NO: 310730 - DNA, 2651 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 310731 - DNA, 2585 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 310732 - DNA, 600 bp, Homo sapiens
ataaggctagatataagaggtgggaaaaattacagataaagagaaaaaagaggcattatataaaggcacttattgccacagattatttaccaaccacacagatggtattcataaaatatatgtgggacaagaaaaaatttagaaagggaaccacagtttcaccatcacccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcattta

SEQ ID NO: 310733 - DNA, 954 bp, Homo sapiens
tggcgtgatctagaggacccccatgcagttatacagactcaatataagaaatttagttaagatatactgcttatgttaaaaattacattttcactgcaaaagcactaaaacattaacaaaaaaatctattcatatttatgctactacaaatattttcatttgtcttcaccaataaacagacaaattttttcatagctttaaaactagaaaagtactttatattttttacttctagtagatttcatattgtcttcataattggaatcaacttaaatatctaacattattgtagctatttcacttagtgagcacactgtaagtttttaaaatggcattcagacaacctgcttataaaaacagactgtgtttacaattcaagcagttaatacagactcagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtctgtattactgcttgggggtcctctaga

SEQ ID NO: 310734 - DNA, 540 bp, Homo sapiens
accctggggactctacattgcaggattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgca

SEQ ID NO: 310735 - DNA, 3962 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310736 - DNA, 3908 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310737 - DNA, 3545 bp, Homo sapiens
  misc_feature (15)..(15): n is a, c, g, or t
  misc_feature (29)..(30): n is a, c, g, or t
  misc_feature (75)..(75): n is a, c, g, or t
aaggtagacacatanaggatccccgtcgnngaccgctatggttcctgattgaatgcactggattccatgcagcanattgaatgcagtgtaagcggtcgacggaagcggtcgacggaagcggtcgaccgtccgtcgaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310738 - DNA, 2941 bp, Homo sapiens
aggatcccccttttggggtcttggctgatgataaaaggaagatgccctttactgaaaaaatcatggcagctccagagcaggcggacaagatgaaggctatcgttgagaagcaccagaagcagatggtgcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310739 - DNA, 3090 bp, Homo sapiens
tggcgtgatctagaggacccccatgcagttatacagactcaatataagaaatttagttaagatatactgcttatgttaaaaattacattttcactgcaaaagcactaaaacattaacaaaaaaatctattcatatttatgctactacaaatattttcatttgtcttcaccaataaacagacaaattttttcatagctttaaaactagaaaagtactttatattttttacttctagtagatttcatattgtcttcataattggaatcaacttaaatatctaacattattgtagctatttcacttagtgagcacactgtaagtttttaaaatggcattcagacaacctgcttataaaaacagactgtgtttacaattcaagcagttaatacagactcagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310740 - DNA, 3446 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310741 - DNA, 4014 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactttccagaacaacaaacatacgacgaaacagtgaaccaaacagacaagcagggg

SEQ ID NO: 310742 - DNA, 4014 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttaaaaaaaaattataaaaaaaagtcgacgcggcgcaatttagtattataacta

SEQ ID NO: 310743 - DNA, 2657 bp, Homo sapiens
tatcggtcggtccgggtgtgggagagaatgtctctgaagtttcttgcacacagccctggctggttgttataagctgttaatgcagcctgcactcaggaagccctgatgtttaaaggaactgtgtctttgttcttcctctcttccctctttctcttagtcccactttatctcttctttctcttcctctccctcctccttttcctctctccactcccgggagtggagagagaagcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310744 - DNA, 2454 bp, Homo sapiens
  misc_feature (17)..(17): n is a, c, g, or t
ctactcaaaaaaaaaanaaaaaaaaaaagcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310745 - DNA, 2479 bp, Homo sapiens
  misc_feature (4)..(4): n is a, c, g, or t
cggnaaccattgccatgattcgatcgagctccttcccgagtcttgcggaaagcgcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310746 - DNA, 2387 bp, Homo sapiens
gggagcttagcctgacgagttcttcgaggaggacaacatgctgagcatgggcaagaagatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310747 - DNA, 2367 bp, Homo sapiens
ccccactgcagttctaacagagttggaaatgactctcaatatttatatatagagagaaagggtgaggaagaaagaaggaaacagaagagaagggaagtctggtcaaataacaggaggtaaaatgagagaaagccattgacctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310748 - DNA, 2180 bp, Homo sapiens
acagatgagtcataacactgccaagtgacatgtatccatgctgcgaacctgcgattggtcctgcagtacgatacattacgataccctgtgtgtgattttgttccccaaaacaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310749 - DNA, 3908 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310750 - DNA, 1825 bp, Homo sapiens
  misc_feature (17)..(17): n is a, c, g, or t
ctactcaaaaaaaaaanaaaaaaaaaaaaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310751 - DNA, 1738 bp, Homo sapiens
cggacgcgtgggcacacttgactcccataggacaacagtggtaggggagaggaggggagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310752 - DNA, 3708 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310753 - DNA, 3543 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctctccactcccgtggagagagaaagaaaaagcacagtctattcatccaggacaatcagtaaaaatctacagtaacctgatcaagcaaaaaatccttaggtgttgtgaaattacattggtcacttctgttatcttaaaacttaaaatgatggtctcatttacaataaatgattctaaaataatatgatggtctcatttacatagcaaatgattctaaaataatgtatatccttctctcttcacccggggtacggagct

SEQ ID NO: 310754 - DNA, 3280 bp, Homo sapiens
  misc_feature (3241)..(3242): n is a, c, g, or t
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcacagccgnntcctcacgtaaagctaccaccacagaagcagtcatcac

SEQ ID NO: 310755 - DNA, 3421 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctcactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 310756 - DNA, 3337 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacagttgacagtgtctgtctggagttgtacagaaagtgtgggattgcaactcaaccacctgttacagagtactctctgcagggctctcagatggcacggtaaggttggcgtaggtaatatggggtggctcacccaggattagtcaaaggtggggacaattcgcgcccacctttgtgggg

SEQ ID NO: 310757 - DNA, 2433 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctacccacaccacctgagtccctgaatgggttgtcaattgactgaaaagtaaattcccagtgagtttgaacctccacggtttttgagacagtattaaaagcttgagaacggagattatggatggcgcgggt

SEQ ID NO: 310758 - DNA, 2304 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacctctctccactcccgggagtggagagagaaggttagatgaggaggagcttggggaggcttaggggttggatttggagtcaggaatggggacaagattggggatggggacatgggtgaagttggcttcgggagtggaggactagggttgggaaatggctaggtgaggggtggatggtgagagataggcttggaggataaactggagttaagggttgagtcagggggatgatgggtggtgggcttggatggggacagtgtggggtgtgggacctggacaaacaggacgagttctgtagtcctggctggggactccatcttctgatcaatgc

SEQ ID NO: 310759 - DNA, 1775 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaagcaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaag

SEQ ID NO: 310760 - DNA, 1932 bp, Homo sapiens
gggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaactgacgaacgacagacacgcgtgacacactggccgacgacacggacgacacacgacgacacgacttgacaccgggacgacacggacggacgctgactggacgacggctgacacgccgactcgacggacacacgacctaacgcaagcggctacacgaacaacgaacctggacacgaacgacagacacccgatacgggactctggacacctatgacgcacggacaccggacacgcgtgcccacgagacgacggctgacacacagcctgggccccaaagagaggacgtcaacgaacagctggaagacgggccaaaggagtggcctttgacgtggacagggccctccgcgaggacccaaggacacaaaagaacatcacaggaaccacgcatgggcactatgagaacaatgcgcaaggaaggctgacacgcctcgaagtcctcccccacgcttgggacagcatagggccccaggaacagcacaggcaagggacgacagtagacgggcttgtggagagatgggcacagccagcaagggccccaacatgggtaccagggacaggacgttgggacgaaagaaccccagttggatcggacgcttagaacaggacctaggcgccatgaggacacacccattccatagttgggcacacggcctgggtagaagcacaatggcacgccaaggctggacccaaagggattagcgcaactggaggacagagggaaacatgccagaacataaagagggcaggccggcttcatgcgccacaga

SEQ ID NO: 310761 - DNA, 414 bp, Homo sapiens
gaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggaca

SEQ ID NO: 310762 - DNA, 876 bp, Homo sapiens
ttttgtaaaggtttgtccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgtgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgatggggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctgtctttttttgattttatta

SEQ ID NO: 310763 - DNA, 2881 bp, Homo sapiens
  misc_feature (650)..(650): n is a, c, g, or t
  misc_feature (1113)..(1113): n is a, c, g, or t
  misc_feature (1245)..(1245): n is a, c, g, or t
cacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggtcgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggcagcctctttttctctggggacagcactggcagcccctgacccacatcatggggtgagcaagtgtccccagagctcctgtccacaggctgatggaggtgccccgggcctgggagcagcacgncttccccagagacctcatgggctccgtagtgacatgctccctcgattcccaccgctaccaggcagagctggcctccagccccacactcctctcctcgtggggctgtcctgttcccctgctgggccgcccactgccctatgagcaggggcaatgtctgttgttccttctctggaacatgataggagcttctcagaggatgctgtgtgtgtgttctcagcacgcagattctgcccagtgactcctgagtggcggcttctccctgcgttctggtctcagttaccttggctcatcagttctgtgcccctcactcaaagggaatgaacttcctttcgcacaggttcaagtccccacccttctcgggaacacatctcctgctccctcctccatatcccagcctcctgacgaggctgtgagtcctgccaggctgccccttcacaggcagaggggttccactgtggtcctnttcttccttctgggcccatggggtctgcacggccgtcagcgccaacctgagaaagcaccgaagaccttgtcttgcattggcctccgggctcccctcaccaccctctccacacgaatgatgaatgtaccattntgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtaccagaggggccccagacgcgtggggagggtgttctctaggtgggggctgggttttctagggaaggcagatcaccgtttgattttaaatgtcattagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcactttgggaggccgaggtggacggatcacctgaggtcaggagtttgagaccagcctggccaacatggtgaagccccatctctactaaaaatacaaaaattagccaggtgtggtggcaggcgcctgtaatcccagctactcgggaggctgaggcaggagaatcgcctggaccccaggaggcggagattgcagcaagccgagattgcgccactgaactccagcctgggcagcagagcgggatttcatc

SEQ ID NO: 310764 - DNA, 2362 bp, Homo sapiens
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaa

SEQ ID NO: 310765 - DNA, 6060 bp, Homo sapiens
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatcccctcccatcttccccagacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatttacatgtaatggaaacatgaaaaagttttattaaacaattgttcatagctgtgtagacattttaattcagtttccaaagctctcaaaaaatcgtatttttgaagtacggagtgatgcggtttggggcgtggcttacagttccaacgactcaattgtcccgatactcagttctttctacaggtatcaggttcgtgttaaacgctgtatgttaactatgactggaattctgtgatattttggtaataaatgaagtgggatcattgcg

SEQ ID NO: 310766 - DNA, 2752 bp, Homo sapiens
  misc_feature (2378)..(2378): n is a, c, g, or t
  misc_feature (2382)..(2382): n is a, c, g, or t
  misc_feature (2430)..(2430): n is a, c, g, or t
  misc_feature (2435)..(2435): n is a, c, g, or t
  misc_feature (2444)..(2444): n is a, c, g, or t
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaaaaaaaaaaaaaaaaanaaanaaaaaaaaaaaaaaaaaaaaaaaaaaaaaaaaaaaaaaaaaaaaaaanaaaanaaaaaaaanaaaaaaaaaaacacacgaaccccacaagaaaaaagagagcgggagggggcagaccattcaaatcaaaccgcccgccggcgcagcagaacgacctagaggcgaacccacgccaccccctgagatagacggagcacgcgccgacccaccagtcgagtcgactagagtaaaacagactcaagccgcggcccgccactactaccaaccctgtcggcgagacaatcaacccatcgagcacgacctgacgatggggaacgcacaccaccatcgcgcggcgcgacaacaacgagagcagccgcaacaccccacga

SEQ ID NO: 310767 - DNA, 3038 bp, Homo sapiens
  misc_feature (2378)..(2378): n is a, c, g, or t
  misc_feature (2382)..(2382): n is a, c, g, or t
  misc_feature (2430)..(2430): n is a, c, g, or t
  misc_feature (2435)..(2435): n is a, c, g, or t
  misc_feature (2444)..(2444): n is a, c, g, or t
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaaaaaaaaaaaaaaaaanaaanaaaaaaaaaaaaaaaaaaaaaaaaaaaaaaaaaaaaaaaaaaaaaaanaaaanaaaaaaaanaaaaaaaaaaaaaaaaaaaaaaaaaaaaaaaaaaaaaaaaaagcgaggagggggaggcgcccttcacagctgtcctaccagacggagccgccgcacaacgtccaccccccaaatgaagaagacgggcaccacatcagcccatactaggcgacagcgagcaccgacgacccccaccaacaaacccgcgaacgattgaggacacacgaacgcatcgctcgacacaagacgatacaaccatctatggaaggagacaggcagcccacatactacactcacagaaggagcgagagagaccaaagcaacaacagagcacagagaagccagcatcaacacaagctccatcatgcgccaatgccagctagcaacaccgcagcgagcggctgaggaggacgacaacaatagcacgacgacgagaggaggaacagacagagaggcgagaggacagcacacgaaccgacagcctgcggacccacgaagacgcatcggcgccgcgaagagaaaaataccaacgcctcgacaccgcagcaggagagcaggcgctcacaacaagaaccacataccgcccagccacacgacaccccaacaagccccgcg

SEQ ID NO: 310768 - DNA, 2301 bp, Homo sapiens
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatgggggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaa

SEQ ID NO: 310769 - DNA, 3749 bp, Homo sapiens
  misc_feature (650)..(650): n is a, c, g, or t
  misc_feature (1113)..(1113): n is a, c, g, or t
  misc_feature (1245)..(1245): n is a, c, g, or t
cacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggtcgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggcagcctctttttctctggggacagcactggcagcccctgacccacatcatggggtgagcaagtgtccccagagctcctgtccacaggctgatggaggtgccccgggcctgggagcagcacgncttccccagagacctcatgggctccgtagtgacatgctccctcgattcccaccgctaccaggcagagctggcctccagccccacactcctctcctcgtggggctgtcctgttcccctgctgggccgcccactgccctatgagcaggggcaatgtctgttgttccttctctggaacatgataggagcttctcagaggatgctgtgtgtgtgttctcagcacgcagattctgcccagtgactcctgagtggcggcttctccctgcgttctggtctcagttaccttggctcatcagttctgtgcccctcactcaaagggaatgaacttcctttcgcacaggttcaagtccccacccttctcgggaacacatctcctgctccctcctccatatcccagcctcctgacgaggctgtgagtcctgccaggctgccccttcacaggcagaggggttccactgtggtcctnttcttccttctgggcccatggggtctgcacggccgtcagcgccaacctgagaaagcaccgaagaccttgtcttgcattggcctccgggctcccctcaccaccctctccacacgaatgatgaatgtaccattntgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaa

SEQ ID NO: 310770 - DNA, 1353 bp, Homo sapiens
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgtgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgatggggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctgtctttttttgattttatta

SEQ ID NO: 310771 - DNA, 1395 bp, Homo sapiens
agcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcactttgggaggccgaggtggacggatcacctgaggtcaggagtttgagaccagcctggccaacatggtgaagccccatctctactaaaaatacaaaaattagccaggtgtggtggcaggcgcctgtaatcccagctactcgggaggctgaggcaggagaatcgcctggaccccaggaggcggagattgcagcaagccgagattgcgccactgaactccagcctgggcagcagagcgggatttcatc

SEQ ID NO: 310772 - DNA, 1230 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310773 - DNA, 1397 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaaaaaaaacaacaaaaaaaaaaaaaacatttggggcggctcgggcaatcgactttaaactgagcaagttatgcatgcggcgcatttgagccacttggcaattcgccataggagggggttaaattactgggcggggttacaaacccggaagggaaacccggcctaccca

SEQ ID NO: 310774 - DNA, 1001 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataagatggagaaacctgtctctagcaaaaaagaaaaatagtaaaaattaacag

SEQ ID NO: 310775 - DNA, 999 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310776 - DNA, 525 bp, Homo sapiens
  misc_feature (1)..(1): n is a, c, g, or t
  misc_feature (36)..(36): n is a, c, g, or t
  misc_feature (135)..(135): n is a, c, g, or t
  misc_feature (159)..(159): n is a, c, g, or t
nggcagcacggtggaagggaggcaaggagccgccantgccaaggaggagagggggcacaagccgcaggcagggaaggtggcaccaaaactagtaagaacaaagcaaaaccaccgtggcccacactgctctctccntttattcctctctttcctgccctntataccaacggcataagaagcctgcacaaagagaaaaatccgtatatccagttatcccttctgtcgtcttctcgcagccgtccagaaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310777 - DNA, 303 bp, Homo sapiens
taatagctgaacctgttcaaaaaaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310778 - DNA, 773 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagtggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310779 - DNA, 751 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310780 - DNA, 631 bp, Homo sapiens
  misc_feature (1)..(1): n is a, c, g, or t
  misc_feature (36)..(36): n is a, c, g, or t
  misc_feature (135)..(135): n is a, c, g, or t
  misc_feature (159)..(159): n is a, c, g, or t
nggcagcacggtggaagggaggcaaggagccgccantgccaaggaggagagggggcacaagccgcaggcagggaaggtggcaccaaaactagtaagaacaaagcaaaaccaccgtggcccacactgctctctccntttattcctctctttcctgccctntataccaacggcataagaagcctgcacaaagagaaaaatccgtatatccagttatcccttctgtcgtcttctcgcagccgtccagaaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaaaaaaaaaaagaagagaaggtttgcccgttagtgagggctaggtatgcgcggcgccggtttattaggtagagtatgcccgcggagtttgtacggggttgtggagga

SEQ ID NO: 310781 - DNA, 256 bp, Homo sapiens
  misc_feature (41)..(41): n is a, c, g, or t
  misc_feature (54)..(54): n is a, c, g, or t
  misc_feature (76)..(76): n is a, c, g, or t
aattccggattgccttcttttaccttggatcttggcccttnacattttcgatgntgtcactgggctccacctccanagtgatggtcttgccggtcatgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310782 - DNA, 182 bp, Homo sapiens
taatagctgaacctgttcaaaatgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310783 - DNA, 834 bp, Homo sapiens
  misc_feature (735)..(735): n is a, c, g, or t
gcgtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagatgncagaaagggccaactgggcggcagagggaaaagggggcacttggaaaaaccaaaggggccgaagagcagcagaggggaaaaagaagaaaaacaaaagaa

SEQ ID NO: 310784 - DNA, 770 bp, Homo sapiens
gcgtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgcagatcttcgtgaaaacccttaccggcaagaccatcacccttgaggtggagcccagtgacaccatcgaggcttattcttggaggcagcagctgaagaatggcgactcttctgatacacatcagggagcgaccctgctggcctgcgtg

SEQ ID NO: 310785 - DNA, 1254 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtagaggggggggtaccgagctcgata

SEQ ID NO: 310786 - DNA, 2050 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtacatacttggtgttttgtcatgaaattctctagtgatgtgtgggtacgcttaaaactggtgaaaatgtttagggatttaattttgagattggtaatgtgctcaaagttaagtcacttgactttggtatacacttgggtgggctgaggggcaagagccttctttgctgtttaagtcattacaagttaggatcctgggtaaatggcaaactttctgaagctcgaatttaaagtctgttgggaggccgaggcaggcggatcacgaggtcaagatatggagaccaccctggccaacatggtgaaaccttgtctctactaaaagaaaaaaattagctgggcgtcgtgtcgcctgcctcagtcccccacatagctgggactacaggggcacaccagctaatttttgtattttcagtagagttggggttttaccatgttgaccaagctggtctcaaactcctggcctcaagtgatccgcccaccttgacctctcgaagtgctgggattacaggcatgagccatcacgcccggccacgctgttggttcttaatgacacagcttaactttattgtgaaaagattgcagcaacaaatgagattttacctgtatttgttaaaaatgcttatccttgtctaagactggcaacataagcagttcttaggcttctatgccaatggacactaggcagtaatacatgtgcagtgctaatagaaaatattggagtaagggtgtactaaggaagttctcaatctttccccttcactatcttctgtaatgtaacttcaataaatgtgattctcatcttggcacaaaattgggaatggtgt

SEQ ID NO: 310787 - DNA, 1267 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaaaaaaaaacaaaaaaacaacaacacaaaaaaaaaaaa

SEQ ID NO: 310788 - DNA, 1308 bp, Homo sapiens
  misc_feature (1232)..(1232): n is a, c, g, or t
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaanaaaaataaaaacaacaacagacaaacacacaacacaaacacaaccacagccggaacaccgcaactacacaaacaaa

SEQ ID NO: 310789 - DNA, 1636 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaaaaaaaaaaacatccccaaaaaaggggggcgcggcaaaaaataccccccggggggcccattcgcgcctacccgttttttgcacaggggccccaaaaggagtcgctataacaaaccaagccggccccgcgtatacccgcgcgcgccggggacaacgccgccggcgacctgggaaggaccacactcgggccggggcaaactggggccaccaccacagaattaagcccgggacaataaactccgggtcaacggtaccacctatgcccgccgacgtgccgggcgatgaattaagagcgcactaaacccacacacgcgcacgcgccagcgacagcacgacacgacgaccacacacacgagcacagagcacaccgcctcagcccccacaacgcgggacgagctcccctgata

SEQ ID NO: 310790 - DNA, 1568 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtattaacaaaaaagaaaagaacgaaaagaaaaaaaattggggggggggctgggcgctcgggaaagagggttttaaaacacacattggtgttgggggggggggcccaaagagggacaggtcacgacacgggccaccaaacacggtgacccaaagggagaaccgggggcagagaccaaaaggaccgggaacttctcacgaaggaaaaaaaccccccggggggcacaccgccgacgggttcgaacacacatcgcagaggcggggaccggacgggaaccagagggagacaaacacacgaggagtcagggacgcgcggaataaatgccgacccgggggggggaac

SEQ ID NO: 310791 - DNA, 1290 bp, Homo sapiens
  misc_feature (1243)..(1243): n is a, c, g, or t
  misc_feature (1251)..(1251): n is a, c, g, or t
  misc_feature (1285)..(1285): n is a, c, g, or t
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtaaaaaaaaaaaagngggggagngaaaagcggccgctcgaattgtcgacgcggccgngaatt

SEQ ID NO: 310792 - DNA, 1280 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgcccttatcgagccaactagttgtacgcctctgaactacaagtcaacaatccaattcagcaaggaacaacagtgtcaacagctcattagcgggtggggaccggatttccaaatcaactgtcttgccttatgga

SEQ ID NO: 310793 - DNA, 945 bp, Homo sapiens
gtatcaacgcagagtggccattacggccgggagttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310794 - DNA, 947 bp, Homo sapiens
aaaacctgctatagagctgggttaatcggccgaggttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310795 - DNA, 958 bp, Homo sapiens
  misc_feature (8)..(8): n is a, c, g, or t
gaaaaatnaataggctaggtacgaggcgggtgtgaatcggccgaggttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310796 - DNA, 1084 bp, Homo sapiens
  misc_feature (49)..(49): n is a, c, g, or t
ttcttttggttgtcgtgctgagtctatgatcttttcgaggtcatagcantaggaaccgtaatgactgaagatgagtattgcagggattcaccttagtcctgtgttctttcttgagtaaccgtggtccgtagggtcattaccctgaatggccccaatttgggctcccttcaagttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310797 - DNA, 986 bp, Homo sapiens
  misc_feature (6)..(6): n is a, c, g, or t
  misc_feature (30)..(30): n is a, c, g, or t
  misc_feature (67)..(67): n is a, c, g, or t
gtgcangaaacctttattaacattttgaanaggttcagctattactgaaacttgtaatttctaaacntaagttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310798 - DNA, 964 bp, Homo sapiens
gccacaagccaaccaaaaaaacaaatatacggctaggtacgaggactgggtgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310799 - DNA, 936 bp, Homo sapiens
actctagagatcccttggctcatcttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310800 - DNA, 971 bp, Homo sapiens
  misc_feature (4)..(4): n is a, c, g, or t
  misc_feature (17)..(17): n is a, c, g, or t
  misc_feature (21)..(21): n is a, c, g, or t
  misc_feature (32)..(32): n is a, c, g, or t
ccgnggtggcggccganctanaactagtggtnccccggcctgcaggaattcggcacgacttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310801 - DNA, 944 bp, Homo sapiens
catagagaaaatagtaattgagctgtagggggttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310802 - DNA, 1161 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310803 - DNA, 1446 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagagggcttcatttcttttggccaagggcaaaggccaggcttggggaaaagaattggggccggaaactcctttttccttggaacttaaacaaaacattcccaagaaaaggaagttccgaacccttggaaccttgggttccttggccggcccttggaaggggttgggctggtttaattccttccagtcccattgtgccaatttccggaaaggtggccccccaggatggaacttggtgcatttaaaccttctctgtgcaacctatatttagcgcccaatgtatggggcccccacaagacctgtaaaaaggagtcttacaggagaacacacttagcccacagggtttttcaacagggtataagtctaggcctgtgacgccccccgggtatcacaagccacattgggtctaacctctaagacacggcgctaccacgggtgatggggagatgggggtatacacaacaacgacgacaa

SEQ ID NO: 310804 - DNA, 913 bp, Homo sapiens
  misc_feature (62)..(62): n is a, c, g, or t
tcggcacgagggtgtccccatgagcctgtacgtcgtgaggtcgagtcggaccggtgcctggnatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310805 - DNA, 864 bp, Homo sapiens
agcgggagtttccagagctttcgaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310806 - DNA, 865 bp, Homo sapiens
ggacgcgtgggtcgacccacgcgtccgtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310807 - DNA, 884 bp, Homo sapiens
atagttgactcctagaggatcccccgctttatcataggaggtggtgtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310808 - DNA, 938 bp, Homo sapiens
  misc_feature (10)..(10): n is a, c, g, or t
  misc_feature (57)..(57): n is a, c, g, or t
gcccgcgacncgccgcgtcgatacgggcgaaaaagacgacagaaggggtcctgtggntggaactggggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310809 - DNA, 905 bp, Homo sapiens
tggggcctcatatttgcggagggtgtacgggggctccacctcaaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310810 - DNA, 1453 bp, Homo sapiens
gcgtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310811 - DNA, 824 bp, Homo sapiens
ggcgttcagaggtcccgggttgacttcgggcaccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310812 - DNA, 1203 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310813 - DNA, 1206 bp, Homo sapiens
  misc_feature (954)..(954): n is a, c, g, or t
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagatgagtncgcacaccagatatccagacagaagggcttcactcctcggcgcggggcagagccaaggtggggaaaatgcgccggcacctccttttcttggagctacgaacattccagggaaaggagttcgaaccctggaagcttggatccctgcgccctgaaaggggtcgggctgttcaatgccttcaggcatgggccatccgcagtgccccgtgataggccttatctgtggacgatagccattggccgacaactaagtta

SEQ ID NO: 310814 - DNA, 1097 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagatggcgaaggacgccagggatcacagcgagcgagtcccaacccacgagcagacagaaagcaaaacactgagcacggcagcagcccgcgcgagaagactgggccgcgacgccaaccccgcagcaccacgatgcaagaaacgaggcgaccct

SEQ ID NO: 310815 - DNA, 1089 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagattgagctggcagagtcgctggtgcaggcgggcacggtaccagtagctggcaccaagcatcaccaggaccaataagaccaggaggctgaggagcagccctgtggtcagggagctggttgctttgagctgagtggtgcagtca

SEQ ID NO: 310816 - DNA, 1176 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310817 - DNA, 1004 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310818 - DNA, 685 bp, Homo sapiens
  misc_feature (8)..(8): n is a, c, g, or t
gaaaaatnaataggctaggtacgaggcgggtgtgaatcggccgagggaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310819 - DNA, 665 bp, Homo sapiens
ggacgcgtgggtcgacccacgcgtccgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310820 - DNA, 677 bp, Homo sapiens
tgattctatgaggatccccgtccggtgcctctactcaggaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310821 - DNA, 675 bp, Homo sapiens
actgccggttgcctctactgccggttgcctctactcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310822 - DNA, 720 bp, Homo sapiens
aatacggcttagtacgaggcctgggttttaattcggccgagttgggtgagcttgtttgtgtccctgtgggtggacgtggttggtgattggcaggatcctggtatccgctaacagtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310823 - DNA, 1184 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310824 - DNA, 603 bp, Homo sapiens
ccaaaaaaaaaaaaaaaaataaaaaaaaaaaaaaaaaggatcgggtacctctagatcagtgtagaaattgaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310825 - DNA, 1392 bp, Homo sapiens
  misc_feature (955)..(955): n is a, c, g, or t
  misc_feature (1076)..(1076): n is a, c, g, or t
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcgtcatccctgtgaaggctggacgcccatgtgaccatccagtcgacaaactgtgagatggccanagattccacggattatacggatacggtcagtcctctccctggatcccaagcagtagtgctactatctttggcacggctaagctagcgtggaaggaatggccagcactacatttctggactnacatactagtccgagaagcgcagtcgacccgtgtcacctggagtccgtgccgtcgtgacggaggtgggttatggcaggagtcctttcggtgtccaatgagcgcctgcagccgggcgacgcaccatgtcatcgtcctgtgtacggtctggagcccatggtgcactccaggtcgcaaaatgctgcaatggccaagcatccaatgatttagagtagggggcaatcccgacccctgatccagcagagtgctctatctgtggcacggcaggctagctaggaagatgggccgcacatctttcctgagctacaactatccaga

SEQ ID NO: 310826 - DNA, 918 bp, Homo sapiens
gtatcaacgcagagtggccattacggccgggagttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310827 - DNA, 1084 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 310828 - DNA, 884 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccatgagctggcagagtcgctggtgcaggcgggcacggtaccagtagctggcaccaagcatcaccaggaccaataagaccaggaggctgaggagcagccctgtggtcagggagctggttgctttgagctgagtggtgcagtca

SEQ ID NO: 310829 - DNA, 865 bp, Homo sapiens
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaaaaaaaacaacaaaaaaaaaaaaaacatttggggcggctcgggcaatcgactttaaactgagcaagttatgcatgcggcgcatttgagccacttggcaattcgccataggagggggttaaattactgggcggggttacaaacccggaagggaaacccggcctaccca

SEQ ID NO: 310830 - DNA, 682 bp, Homo sapiens
  misc_feature (666)..(667): n is a, c, g, or t
aggaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccccaccgccatcttcgagggnncctctagacaccgca

SEQ ID NO: 310831 - DNA, 1198 bp, Homo sapiens
gcggccgctactactactaaatttacccccgatcgaccacactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtacatacttggtgttttgtcatgaaattctctagtgatgtgtgggtacgcttaaaactggtgaaaatgtttagggatttaattttgagattggtaatgtgctcaaagttaagtcacttgactttggtatacacttgggtgggctgaggggcaagagccttctttgctgtttaagtcattacaagttaggatcctgggtaaatggcaaactttctgaagctcgaatttaaagtctgttgggaggccgaggcaggcggatcacgaggtcaagatatggagaccaccctggccaacatggtgaaaccttgtctctactaaaagaaaaaaattagctgggcgtcgtgtcgcctgcctcagtcccccacatagctgggactacaggggcacaccagctaatttttgtattttcagtagagttggggttttaccatgttgaccaagctggtctcaaactcctggcctcaagtgatccgcccaccttgacctctcgaagtgctgggattacaggcatgagccatcacgcccggccacgctgttggttcttaatgacacagcttaactttattgtgaaaagattgcagcaacaaatgagattttacctgtatttgttaaaaatgcttatccttgtctaagactggcaacataagcagttcttaggcttctatgccaatggacactaggcagtaatacatgtgcagtgctaatagaaaatattggagtaagggtgtactaaggaagttctcaatctttccccttcactatcttctgtaatgtaacttcaataaatgtgattctcatcttggcacaaaattgggaatggtgt

SEQ ID NO: 310832 - DNA, 565 bp, Homo sapiens
  misc_feature (1)..(1): n is a, c, g, or t
naagagtagcacctatggagtctcactatactgcacaggccggagtgcagtggtgccatctcgggcaagcaattctcctgcctcagcctcccaagtagctgagactacaggaacgaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310833 - DNA, 1910 bp, Homo sapiens
cacctcccagagttgagcgattctcctgtctgagcctcccaaacagctgggagtacaggtgcgcaccaccacacctggctaatttttgtgtgtttagtagaggtggggtttcaccatattggccaggctggtctcgaactcctgacctcaagtgatccgcctgcctcagcctctcaaagtgctgggattacaggcataagcttttattttttattgtagagatggggtctccctgtgttgcgcaggctggtcttgaacgcctgggctgaagtgatcctcccacttccacctcccaaagtgctgggattataggtatgagttaccatgcctggcctgcatttaagaatatttttatagcaaataagagaaatgtttgacagcttttataagagatataagtaatttgcttcttttattaatctatttgctatgtacataaggacttaaagctgtttaacgtcccttactaacaggctgacaagatactttagctttcatattgttagaatatcccagaataattgttttattttattctattgtattttattttatttatttatttatttttgagacggagtctcgctctgtcgcccaggctggaatgcagtggcgcgatctcggctcactgcaacctccgcctcctgggttcacactattctcctgcctcagcctcccgagtagcttggactacagatgcccgccaccacgcccggctaattttttgtgttttttagtagagacggggtttcaccgtgttagccaggatggtcttgatctcctgaccttgtgatctgcccacctcggcctctcaaagtgctgggattacaggcgtgagccaccgtgcccggcctatttatttatttttatttttgttgagacagagtctcactgctggagtgcagtggcgtgatctctgctcactgcaacctctgcctcccaggttcaagtgagtctcctgcctcagtctcccaagtagttgggattacaggcacatgccaccatgcctggctaatgtttgtatttttagtagagacaggttttaccctgttggccaggctagtctcgaactcctgacctcaggtgattcacccgtcttggcctcccaaagtgctgggattacaggtatgagccactgtgcctgtcctcccgaataataattttaaaataataaatgaaggacaaaataatttgcactacaaaggctgtggatttgggtatagatttgttactttttcacctaaaatcaaatattttttttgtaagtcaaaagaagaacttttaaaaaataatgattttaaactctttaatactgagatgggctagatgtgggtaagagagaattttattacattccaacctggaaatttctaataaatttacagtgttgacacagatgcctcaaatcttatttggtagacattttaagaatattaatatattgtaagggaagttaaaatagaactatcagtctgtgtgaaatgttttcttggtaaaagtcaaactctttgtttttatttcacagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310834 - DNA, 503 bp, Homo sapiens
  misc_feature (11)..(11): n is a, c, g, or t
  misc_feature (19)..(19): n is a, c, g, or t
  misc_feature (43)..(43): n is a, c, g, or t
ataaaaaaaanttatatantttttaattttaattttttataanaatataaatcttaggacttctttgctgttttaattctggagcctccaacatttagctgggatgaaagacagcattacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310835 - DNA, 522 bp, Homo sapiens
ttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagagttagagaaggaacggcagcgacacatcggcaagcctttacttgggggaccgttttccctcacaactcatactggggagcgtaaaactgacaaggactacttgggtcagtggttattgatttattttggcttcact

SEQ ID NO: 310836 - DNA, 541 bp, Homo sapiens
gtaccactgcactccagcctgagcaacacaatgagaccctgtctcaaagtaataatgataataacaattgttatatagtataatgaaaaagctttcggatgattaaactcccagatgtctgactaagtggcctctagaagaataatttaccatcaataactaaacaaatctctgcttatcgccgtgaagcaggttacacattcccaaaagagaaacacgccaatgcaaatcaacacctgcaattcagaatgtttgttcttgtgcctttggatttgaggctcacgtttgaaacttgtttattgtctctgactatgcatcttaatgtgtgtagcatgtttctctggattagcagttacctggctagaacaaatggacttaacagatatttacagaacattctacccaacaactgcagaatatacattcttctcattagcacatggaacattctccaagagggactattagataggccacaaaagtctcaataaatttaagaaaattgaaattataccaagcaccctctcagactcaggtggtg

SEQ ID NO: 310837 - DNA, 1387 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310838 - DNA, 2517 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcagagttaaaaaagcacggctataaagcatgaatattatcttaaacatactccagtcttcagaagaccatagctaatgtgacaaaagcagacctgacttaaacctgacccagctccatgtatttagttggcttaaggtaaatttcattttccgtttaattttaaggttttgtcagtttataggacttttgtctgtaaaggagggagagtggaggaggggctgctttgagacagcatggcctctgatgcaagcagatagtttgatgttattataaacattcaaaatcctgtgcagagaatgctctagcctttcttttgccttctgttggcttcttttgggctctcttaggaagcacccaggcctgtgtagtcacctctggcactctcattctgctgcccagggcacagctgaggtccaagagtgtcaccagggctgcagctggtgtggatgcaggcccaagagcagaggctggtgaggctttgaacaggcctgcaggaaggcgtgggtaggtaggtgagtagaacaaagagggctgccctcctgaatcagatctgcagaagtaggagtagtgacctggatcaagcagacactagggaagagaagggaagtgataagtgatggaggtggctagagtgcctttgtgtgaccagcctggggcccttccccagctgactagtgaaccctttctgatttgtgtcacaatcagttgctataaaacacttttaaaagttgtaacaaaaaaaaagggggcggtttagaaattcctggggggcaaattagggttccagtttttgtccagggccttgggtgattaagaaggaggcggtttaaggtaggatggaaagtatgggttggagaacaaatggggtgaaggaaactcagattaggcggaataaatagttgtgagattgggattgtatata

SEQ ID NO: 310839 - DNA, 1240 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310840 - DNA, 1520 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcgagacggggtttccccatgttacccaggctggtctcgaactcttgtcctcaagtgatccacctgcctcggcctcccaaagtcctggaattacaggcctgagctaccgcacctggccttagacatcttttttcttgcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310841 - DNA, 1685 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaactaaaaaaaaaaaaaaaaaaaaaaaaaaaaaaaaaaaaaaaaaaaaaaaaaaaaaaaaaaaaaaaaaaaaaaaaaaaaaacaaaaaaaagaaaaaaaagaacaaaaaaaaaaaaacaagagaggaggaggagcaataaaagaaaacagaagagagaaaagaaaaagaacaaaaagagagaaaaaagaaataaaaacaagaaagaaaaaaaaagaagaagaaagaaaaaagaaaagaaagaacgaaaaaaaaaaaaaagaaaaaagaaaagacaagaaaaaaacaaaagaagacaaaaaaaa

SEQ ID NO: 310842 - DNA, 1340 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310843 - DNA, 1158 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcgaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310844 - DNA, 1483 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgtagagacggaggttctgcatgttggtcaggctggtctcgaaatcctgacctcaggtgatccgcccacttcagcctcccaaagtgttgggattacaggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310845 - DNA, 1075 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcgaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310846 - DNA, 2609 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaagcccccttggacagctctcctctgtccaagcagtcacaaagcagctctacactggaagctccagttgcagccactgcactgccacgactaagggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcagagttaaaaaagcacggctataaagcatgaatattatcttaaacatactccagtcttcagaagaccatagctaatgtgacaaaagcagacctgacttaaacctgacccagctccatgtatttagttggcttaaggtaaatttcattttccgtttaattttaaggttttgtcagtttataggacttttgtctgtaaaggagggagagtggaggaggggctgctttgagacagcatggcctctgatgcaagcagatagtttgatgttattataaacattcaaaatcctgtgcagagaatgctctagcctttcttttgccttctgttggcttcttttgggctctcttaggaagcacccaggcctgtgtagtcacctctggcactctcattctgctgcccagggcacagctgaggtccaagagtgtcaccagggctgcagctggtgtggatgcaggcccaagagcagaggctggtgaggctttgaacaggcctgcaggaaggcgtgggtaggtaggtgagtagaacaaagagggctgccctcctgaatcagatctgcagaagtaggagtagtgacctggatcaagcagacactagggaagagaagggaagtgataagtgatggaggtggctagagtgcctttgtgtgaccagcctggggcccttccccagctgactagtgaaccctttctgatttgtgtcacaatcagttgctataaaacacttttaaaagttgtaacaaaaaaaaagggggcggtttagaaattcctggggggcaaattagggttccagtttttgtccagggccttgggtgattaagaaggaggcggtttaaggtaggatggaaagtatgggttggagaacaaatggggtgaaggaaactcagattaggcggaataaatagttgtgagattgggattgtatata

SEQ ID NO: 310847 - DNA, 1318 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310848 - DNA, 1564 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310849 - DNA, 1311 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgtagagacggaggttctgcatgttggtcaggctggtctcgaaatcctgacctcaggtgatccgcccacttcagcctcccaaagtgttgggattacaggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagtaagtattgcaataaaatatgctgtgtaaaatgttatggggataagtactgtatgtatttgttgaacagtgatctcagtgatttaccttactcagtgttcctgagcagttagccagtaccatggtgaatatgtcattttcacaaggtctgtgtagttcttgatcctagtaaaatgcccagcagttcttaaatccagcttattattcaagtattttaaagcagtggaacattttatcaaattaagtcatattacatcaaataaaacattgataaaagca

SEQ ID NO: 310850 - DNA, 1068 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggaactttatattgctgttggaatatctggagccatccaacatttagctgggatgaaagacagcaaggacattgtgggcatataagaccgagctcaattccagtgggcattgggattgtgcgattctttacggagtcctgaaggcgggtttgtggaaaatggtcggctcgtctaaagaacttgtgaggtcccggacccattgggcttcacaccggggcggggccctccctggaggtacaagcgaggtgaggggctctattgcgcccacgtgtttcactactcctt

SEQ ID NO: 310851 - DNA, 919 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtgttggtgcttcccgtgctgctgttgatgctggctttgttcccaatgacatgcaagttggacagacgggaaaaatagtagcaccacgcactttataattgctactgaacttctaaaactaaggggtaccgggctcga

SEQ ID NO: 310852 - DNA, 501 bp, Homo sapiens
  misc_feature (38)..(39): n is a, c, g, or t
  misc_feature (43)..(43): n is a, c, g, or t
gggtggggccggctcgggccggcgcgctttgtatttcnncggntttgcgagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310853 - DNA, 1005 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcgaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccagaccaattgtgggcattaataaaaacc

SEQ ID NO: 310854 - DNA, 922 bp, Homo sapiens
gtaccactgcactccagcctgagcaacacaatgagaccctgtctcaaagtaataatgataataacaattgttatatagtataatgaaaaagctttcggatgattaaactcccagatgtctgactaagtggcctctagaagaataatttaccatcaataactaaacaaatctctgcttatcgccgtgaagcaggttacacattcccaaaagagaaacacgccaatgcaaatcaacacctgcaattcagaatgtttgttcttgtgcctttggatttgaggctcacgtttgaaacttgtttattgtctctgactatgcatcttaatgtgtgtagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaacttttttaattctgtactaaaatctataataaagcttttccacagctttaaaacta

SEQ ID NO: 310855 - DNA, 567 bp, Homo sapiens
cacgcgtcgccacgcgtcgctagttctagatcgcgagcgattaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggtgagtactcaaggaagataattaatcaacatgttaaattttagtgaaaagcataaattaatcttgaagatagaattt

SEQ ID NO: 310856 - DNA, 214 bp, Homo sapiens
cttaacaattagtaaaaaaaaaaaaaaaaaccctgtgacaacattctttacctttttttttcctttttgctctttttaggcctcattgctacgatttcagagtaccctggtaatagctgagcatgcaaatgattccctagcacccattactttaaataccattactgcagccacacgccttggaggtgaagtgtcctgcttagtagctggaacc

SEQ ID NO: 310857 - DNA, 451 bp, Homo sapiens
gagctcatggtctctccactgaggaaagctgggagaagtggtgccagcacttaatgccacccctgagcaaatgcctgctggctccatggtaaacatgggccttttaataggctggagacagtgacattcggaagaaacaacatgtcgacaatttccttaataaattttgtacgaacacattatttccacctaatggaaatgtagctctcttaaataattgagaggctgtattcatcagtggtgagttcagctggaatctttgtgagctaaggcagccgaaagccccttggaagactgggtaattgatactttgcacaagtggctggaccagttttcagagtatctgtgtgacattccctgcagcccccttggacagctctcctctgtccaagcagtcacaaagcagctctacactggaagctccagttgcagccactgcactgccacgact

SEQ ID NO: 310858 - DNA, 738 bp, Homo sapiens
aaagaaaaaaaaaaaagaaaaggaatttgaaaagttgattaaaatgaaattttagtgaagaaaactcagtcttaagggaaatctgaaatgagaaaaacgtttttatttgaagacagtgcagtgtattttgggttgcaagcataagtgattgcttgatgtttattcttctttccagagctgaaaaataatatttttgaggaaaacagcaactattaatggaatgctacatttcttttttttatttattatttactgttgattaaaaaaaattaatagagatggggtctcgccatgttacccaggctggtttcgaactcctaggctcaatcagtactcctgcctcagcctcccagagtgctgggatttataggtgggagccaccacgcctggcctagaatgctgtgtttcacatacgacccagaaacagagcttccaaggtttaaaacattagaaaatggaaaaaccattattctggagacccaaaaagtacatcatatcaaaattagaacaaaggacagtgttgatttgtttctttcgtataattagcaatgcttctgtacagactttttttaagttgaaatttttattaagataattgtaatttctcatgcagttgtaaaaggtaatacaaagggatctcttgtatactttgcccagtttcttccaatggtagcagttttgggaaatttttataacatcacaaccagaatattgacatctggtgtagtacaccagcct

SEQ ID NO: 310859 - DNA, 541 bp, Homo sapiens
caagaaagtggtgaatcccctgtttgagaaaaggcctaagaattttggcattggacaggacatccagcccaaaagagacctcacctcgctttgtgaaatggccccgctatatcaggttgcaatggcagagatccatactctataagcagctgaaagtgcctcctgcgattaaccagttcacccaggccctggaaggccaaacagctactcagctgcttaagctggcccacaaatacagaccagagacaaagcaagagaagaagtggaggctgttggcccaggcagagttgtgggcaaaggggacctccccatgaagagactacctgtctttcgagcaggagttaacaccgtcaccacctttgtggataacaagaaagctccgctggtggtgactacacacgacatggatcccattgagctgactgttttcctgcctgtcctgtgtcataaaatgggggccacttgctgcattatcaaggggaaggcaagactgggatgtctagttcacaggaagacctacaccactgtcgacttcacacag

SEQ ID NO: 310860 - DNA, 1037 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtgaaatagcttccttttggattactcccacaaagctcagacactttgagacatattcgggtaattatctgctgataccagtagtaacaggttatactaagatgtcagttcctaagatctgtcacacagcgaggttgtggtgcggatagcataagtgtctcttgacactgtagtttatatgtaatggttgtaattcagttttaatgatgagtgaagctcagacttaattttctctcttattttgaagtgagttttctgcttcaaaggtgttgtgcaaaaaaaaaaaaatagactgtattgggggggttgacacaaacctgaagtacacctttttctttctcgaagtctgtaaaagttacagatttataaaaactgaaggaatttgggctacagaattttcattggtgcttgctatcctcttccctagtcatttgttgcccagggaacaaaaatagcaattgtttgtatgctgaagttttgtgcttcagtttattttggcctggcatgtgaagtttgaag

SEQ ID NO: 310861 - DNA, 788 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgc

SEQ ID NO: 310862 - DNA, 293 bp, Homo sapiens
cgtgggccgaggccgcgcgcctggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgc

SEQ ID NO: 310863 - DNA, 7165 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310864 - DNA, 7068 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310865 - DNA, 6328 bp, Homo sapiens
ctttgtctcccagggcagtcgtgaggatccaacggaggatttgattatgccagtgctttgtaaaaggtgtagtgctatacaaataaagatggcagtttggcacctgtaaggtgatattttaaagccagaccatgaagtggtggtttctctcagcctaaggctgggagatggaagcatcccagtattgctggcagcatctcagggagagctgggagaaatgagcttgtctgagagccatgggcgcggcttggtgatacttttgaccagtggaatgctgtgccttcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310866 - DNA, 6912 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310867 - DNA, 7111 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccgaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310868 - DNA, 7030 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccgaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggattgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310869 - DNA, 7111 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgtcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 310870 - DNA, 5204 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaa

SEQ ID NO: 310871 - DNA, 6262 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctcta

SEQ ID NO: 310872 - DNA, 6059 bp, Homo sapiens
  misc_feature (6059)..(6059): n is a, c, g, or t
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgtcctctgcttgacatcctccctgtcactttggaccctatgggagtgggcatctccacgcacctgtgtatgtgaaagtcattttacatttcaaaggagccgtgacttttttctttttcatttacccaacaatttattttagagtgtttaaggtgtcctgtggggcctctgggagcaatctctn

SEQ ID NO: 310873 - DNA, 5898 bp, Homo sapiens
  misc_feature (5671)..(5671): n is a, c, g, or t
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaaaaaaaaaaaaaaaacaacaaaaaaaaaaaaaaaaacaaaaaaaaaaaaaaaaaaaaaaaacggcggcgccgcgcgccgagaaaaatatgtccccgcagggggcgccccaaagcctccggccgcccccccgtttttttggaccaaaggggcgcccccaataaaggggcggctgttttatataacccagcggcgcgggggcgcccgttaaaaccacccgcgcgcggggggaacaaccgcgtcccctcgggggcgtccttgtgggggagagcgcccccctctcctgctgggggggggcgagcaccaattttgggggcacccctccaccctgccgtgatgattatgacgggcccctcgggcgcaatatcaaaccctgcggcgtgcctctgtggtggcttccccccccgcgcataatgtcctgcgcccgagaaaactggcccgcgggcatatctttcgccatttttcgcgcnggtcgtgtaaataactctccccctcctcctcaccccctcccgccaacgccccactcaccccaccaccacccccagcaccacctctcactccaactccccccacgcattccctctactcactgtcatcactaccgcctactcacaccccctaccacaacccatcacaccccatcccacacaacaacaccacctcctcttcacctaccacatccacactcccacccccc

SEQ ID NO: 310874 - DNA, 2070 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaa

SEQ ID NO: 310875 - DNA, 1212 bp, Homo sapiens
gaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcaggtatgtgtaaactcatggttgtgatgctttttcctcaggtcctggggacctggcctccctctgtcagcagtttctgacctaatagtgcg

SEQ ID NO: 310876 - DNA, 2771 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaaccaa

SEQ ID NO: 310877 - DNA, 3187 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaaccaaaaaaaaaaaaaaaaaaaaaaaaaaaaaaaaaaaaaaaaaaaaaaaaaaaaaacacaaaaacaagagagggggcgcgcgccgccaacagaaggtccccgccccgcgaggggcgccccaccacctacggcgcgaccacccgccgcgtctcgcgcagcaaaagagggcgcccccatataacgagcgcgccgctactaaacagcagcagcgcccctgccgccggccattatcacagccgcgagctcgagcgcgggggacaaaccacgcacagcgcgggggaaacctagtgcggcgagaggagcacacccacaatctgccggggaggagcgcgcaccacccaggtcgggcgccgcaaaccaccccgcagcgcgaatctcaagccctctcaagcgacgcacactatacccacctccccccga

SEQ ID NO: 310878 - DNA, 2696 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaaccaa

SEQ ID NO: 310879 - DNA, 2222 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgggccgacactagtatgatgcagtgtccagtgtgaacagcagaaattaaacatgttgcaaccaa

SEQ ID NO: 310880 - DNA, 2193 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaattgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctcctttgtgcaggcgaggaaggggtgccctcaggggccgacactagtatgatgcagtgtccagtgtgaacagcagaaattaaacatgttgcaaccaa

SEQ ID NO: 310881 - DNA, 598 bp, Homo sapiens
attaccattcgagctcggtccccagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtatgatgcagtgtccagtgtgaacagcagaaattaaacatgttgcaaccaa

SEQ ID NO: 310882 - DNA, 1049 bp, Homo sapiens
ctcattagagtttaatacacaattattttatttcctgccaatctaatggcgaagacatggaataacccatcaaacagcccagtaaccccaggaaaccagagggacggaaaccagggcgatgggcgagtcagtcatggccagtgcgccgtgtttcgaaggggacggccatggagcggtgggtggtcgctcagctccccaatcgctctccgacacccggctggggagacaggacctccctggaggccgcagcagcttgattgtcacccgggcaaccccaccttccggttccctctacaaccccttgccccgcttccggttccggcgtcgtgcgtcatcgctgggcgactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccagggccgacactagtatgatgcagtgtccagtgtgaacagcagaaattaaacatgttgcaaccaa

SEQ ID NO: 310883 - DNA, 254 bp, Homo sapiens
cacgttgatatacatatatttatatattagaataggcatacatacatatatgaaacagacataccaacatatatattgtgtatgtctgattaagcatcaaccccctacacatgaaactaataatactgcttttctgtggagacaagaacacaagagtggaaaaaggtctgttcatcgtatactttttcagttcgaattctcaaccatgtgaatgtattacttattgaaaataatacattggcaaagtaaaataa

SEQ ID NO: 310884 - DNA, 546 bp, Homo sapiens
cataggaacataaaatttggatgaaatctggtactgcatggactggagggcagaggagttagattccagtggttttctaatttggtttctgacttctgccagcccccaacccattcctttctaagattcgatactctggctgggctctggctgacttccagccttctcagatggagccaggattacatctgtgtctttgcattttgtatccaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagtgagtacttctcttggccatgtcccaggatggagactcagctataaatggggatattggattaacattttctttttatgacccttagccacaaaggtcttggtgtgatgatgtcagcaggagtaagattgtatttctaaataaccaactcctggaaaagaaaaaaatggatttaaaaaaa

SEQ ID NO: 310885 - DNA, 4853 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310886 - DNA, 4856 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310887 - DNA, 4511 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310888 - DNA, 4505 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310889 - DNA, 4586 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310890 - DNA, 4945 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310891 - DNA, 3290 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattccccccaacccttcccttatgagcatttttagaaaatagtcttagccaatgttctaaaatgctcataaggaagggttggggaattaccctttagacacaagctctaagaactctggatacaacgggaacttggatggatacagtctgggcctgctgggccagatgttccgagggcggcccggcaagcagcctgtcttgcacattgcaactgactggcttaatctacggcaagagtccttcagctccgtcacagagtactctccaatgtgttatagttatccttaaagctcttcaattcaaggaagtgcttggcacgtttactcttctgactggaggggaggtatgtcacctggatggttgttggggagacctcaggggactgagttaggtctttggctgctgactggtgatgtcgctgagg

SEQ ID NO: 310892 - DNA, 3480 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatctc

SEQ ID NO: 310893 - DNA, 3501 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggctgccagcctgggcatcacaagagaaagagaactcccagacctccctttttgcaatatcccatgtaactctgagctccattagcaaaaccagaagttccgccaaaagagatgagaagcctgggtcctccccacacctggccctggtacgcagccaggggctgcctcagtcagtggtgccatgacacctggggcaagacagcacagtgttcctccccggcatcaggctccaaggtggggaacatctcaaagcactctagttttccttgggagtcactcagataaacagccttttaaaaaacccaaaaaacaaaatgcacatcttgttgacaaagtccagcctgc

SEQ ID NO: 310894 - DNA, 3477 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatctc

SEQ ID NO: 310895 - DNA, 3375 bp, Homo sapiens
  misc_feature (3158)..(3159): n is a, c, g, or t
  misc_feature (3162)..(3163): n is a, c, g, or t
  misc_feature (3167)..(3168): n is a, c, g, or t
  misc_feature (3173)..(3173): n is a, c, g, or t
  misc_feature (3178)..(3179): n is a, c, g, or t
  misc_feature (3181)..(3181): n is a, c, g, or t
  misc_feature (3221)..(3221): n is a, c, g, or t
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagnnaannctcnntctanaaccnntnagaacttccagagcacctcaggaagagagggcacggagantcatgctcttcaatgcctcagatcggaagtaacacctgccatttcctgtgagagcccattggctgacactggttccaaggtcccaaactaactacatgggaagcaggaagcaccaagaagctgatggagaatcgggttttggaagcaatagtga

SEQ ID NO: 310896 - DNA, 3358 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagcggtacaagctgcttccctgtcctgacaagcacaataaaaggtgcaaacctgaggaacgtggggacctcacagaggcaggcgcagccggctcatcgagatgtgtggacagcagaaagcgagtgaggcaagagaaaatcagcacagggtaaacatcagagatcaaagggcagcagctggagtcactgggtggagaagcagtg

SEQ ID NO: 310897 - DNA, 3311 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagagcttccagagcagcttaaaaagttcctccacgggaatccccgggtggcctccgggctcggaggtattctcggaggttgcctttagaggcatactcaactatgacatagagaggcccatcctgtgtgcaggctccaagaagatttatgatattc

SEQ ID NO: 310898 - DNA, 3303 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagcctctatcctgaagagcgttggaccctggagctgctggccacatcttgatctgccatatgtggtccaagaatgaagtcaacacgaaggagaatgaaggtgctgagggataaagttattgacattctaggagctcctggatcaaacc

SEQ ID NO: 310899 - DNA, 3261 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagtaaagccaaggatatgggagggaaaaaaaggggaaagagtcatggaaagccagcttcttgctgaaactccactaggtgccctgctggaatctcccttgaaagag

SEQ ID NO: 310900 - DNA, 3213 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatctc

SEQ ID NO: 310901 - DNA, 2046 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagacc

SEQ ID NO: 310902 - DNA, 443 bp, Homo sapiens
gtcatcatggagggaaaatttaagccattaaaactatcttaactgaaaacaatcccaggctctttgcgagggttcctgggttgttgactttgctatggagaaggtctcagttgtagataattgcaacctttttgctttgcaaaaaacacatccatggaatatgttcttttgcatacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacaacttctcta

SEQ ID NO: 310903 - DNA, 438 bp, Homo sapiens
tcgcgatgtgtagaattgcgacgagggcgggagatcgtggggacatcacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgcgcctgggtgcagaggaatagagaaaattagagtttgaacatgtagtaagagtgagtgaatatt

SEQ ID NO: 310904 - DNA, 5001 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310905 - DNA, 4480 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgatagtcattgcgttggagacgcctgttaggatctctaaacagagtgtctgctgat

SEQ ID NO: 310906 - DNA, 4946 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310907 - DNA, 4949 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttggccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310908 - DNA, 4317 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310909 - DNA, 3924 bp, Homo sapiens
gaacccgcagcagtccgagtggtgtctgggagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310910 - DNA, 3496 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagctgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310911 - DNA, 2528 bp, Homo sapiens
cccaagtcggaggaagtgtcaccctggggtgatccagagggctttttgcagcaccagcactggatgccttggggagcagaggacacttctgaatctcgaaccttcaaaactttgaaacttaaccgatattttcctgaagtttcctttaacagtgcattatggatttaacatacatgagtatgtctaagccttttttgaacctgtttacattttcaactcggagagcttctgagagtaatcagttacatctgttaaattacccactgaatgaagaagtattccccttcaattatccccgaaactacaatagtaaaatgtaattcagaaaataaatattcatagtctcaactacttaaagggggtctggggacccacaacatgttaccggttttcattttgctggggctcgcatttgaagcaagggctctagtgaggaggtggtgtagactcagcgggttatttaggtccgtgtgaagccgagttgcctgcccagcacctatagctcaactaggttttattggtctctacctgtcaatagttgatttatgatggattccaagagaaaagctaaggacagcctggggtacatcagacgtggtctcagggaggtcttcgtggaagtcaggtgggctgggtctctgttcaccttctaggggtctcctgtcctgtcccacgtccaatacccacatctcaagagtttgtgtttgaaataaaactcttctcttcccttctttcaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310912 - DNA, 2474 bp, Homo sapiens
cccaagtcggaggaagtgtcaccctggggtgatccagagggctttttgcagcaccagcactggatgccttggggagcagaggacacttctgaatctcgaaccttcaaaactttgaaacttaaccgatattttcctgaagtttcctttaacagtgcattatggatttaacatacatgagtatgtctaagccttttttgaacctgtttacattttcaactcggagagcttctgagagtaatcagttacatctgttaaattacccactgaatgaagaagtattccccttcaattatccccgaaactacaatagtaaaatgtaattcagtgttaccggttttcattttgctggggctcgcatttgaagcaagggctctagtgaggaggtggtgtagactcagcgggttatttaggtccgtgtgaagccgagttgcctgcccagcacctatagctcaactaggttttattggtctctacctgtcaatagttgatttatgatggattccaagagaaaagctaaggacagcctggggtacatcagacgtggtctcagggaggtcttcgtggaagtcaggtgggctgggtctctgttcaccttctaggggtctcctgtcctgtcccacgtccaatacccacatctcaagagtttgtgtttgaaataaaactcttctcttcccttctttcaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310913 - DNA, 2891 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagcatgggggtgtctgccgttgaagagaggcgtgttgttatcctcaccagagaggggcggagcag

SEQ ID NO: 310914 - DNA, 2610 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaaaaaaaaaaa

SEQ ID NO: 310915 - DNA, 1494 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacaacttctcta

SEQ ID NO: 310916 - DNA, 2253 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtgggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagaccacctcgcctgttgtcttggaaattcaagtttcttcccaggttttgcctgtgatgatggggctttgttgtaactaatgaagaaaggaggtttctgtgtcttggaggattgctaacatatggaactctacccaagacatacttcattgttgcaggatggcaggttaagatcccttccatgtaggggccatcttttctctttcctgtcat

SEQ ID NO: 310917 - DNA, 1227 bp, Homo sapiens
atccctacggccgcatcgcggccgagccctcgcctcccgggccggtgtctccggctgctcgaaggcgtccggagccgcgcggaactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacaacttctcta

SEQ ID NO: 310918 - DNA, 679 bp, Homo sapiens
gtcttaacgttttttctttgagccattctaaattacaaatatttaattggctcaagatcaaaagctcttctctggcacttaggaaagctgaccaccgcactagcaaggataccttccctaaagaaaataaaccgagaataccaatgtgaaatttaatagccgttccaccagtaattgacattctctaaaacgtcactaggaaaatactcaggcgcgtgtgtaccctaagtctcattagttccatatgataagcactccatgctttagtaagccgctgaaagatttttatatttagttctggaatttccctcactacaccccatcaccagatgctatgtgctaatcccctatttacacatttaggctgacactgggcaagcccctgggagaaggttgctttgggcaagtggtcatggcggaagcagtgggaattgacaaagacaagcccaaggaggcggtcaccgtggccgtgaagatgttgaaaggtgagcggggaggcgggaggctcggggaggggctgggtggagagtcttatcaagaaagttccttttgtggcatgtgaactctatcatggcacggggtcagagagcacatagttgacctaggggttgagaagttttcggtataaatcagcatctcggacagactatttatcttgagctgtgtgtacttataaaga

SEQ ID NO: 310919 - DNA, 500 bp, Homo sapiens
gaagagattgcacttaaatgaatacagctgaccttcagaagttgaaaggaaaggaacggttcaaggggggaaagaaaccaactttcttcttctgccaaaattgttgtttctagtataagttcctttaactgtagacttggaatctactgatatccctgtttttttcctatcagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttacagtgagccgagatcatgccattgcattccagccttggcgacagagcgagactccatctcaaaa

SEQ ID NO: 310920 - DNA, 1825 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310921 - DNA, 977 bp, Homo sapiens
  misc_feature (36)..(36): n is a, c, g, or t
  misc_feature (61)..(61): n is a, c, g, or t
  misc_feature (67)..(67): n is a, c, g, or t
  misc_feature (70)..(72): n is a, c, g, or t
  misc_feature (76)..(76): n is a, c, g, or t
  misc_feature (79)..(79): n is a, c, g, or t
  misc_feature (93)..(93): n is a, c, g, or t
  misc_feature (95)..(95): n is a, c, g, or t
  misc_feature (114)..(114): n is a, c, g, or t
  misc_feature (123)..(123): n is a, c, g, or t
  misc_feature (177)..(177): n is a, c, g, or t
  misc_feature (189)..(190): n is a, c, g, or t
  misc_feature (194)..(194): n is a, c, g, or t
  misc_feature (196)..(196): n is a, c, g, or t
  misc_feature (210)..(211): n is a, c, g, or t
  misc_feature (220)..(220): n is a, c, g, or t
  misc_feature (232)..(232): n is a, c, g, or t
  misc_feature (250)..(252): n is a, c, g, or t
  misc_feature (255)..(257): n is a, c, g, or t
  misc_feature (266)..(267): n is a, c, g, or t
  misc_feature (271)..(273): n is a, c, g, or t
  misc_feature (309)..(309): n is a, c, g, or t
  misc_feature (314)..(314): n is a, c, g, or t
  misc_feature (323)..(325): n is a, c, g, or t
  misc_feature (328)..(328): n is a, c, g, or t
  misc_feature (356)..(356): n is a, c, g, or t
  misc_feature (373)..(373): n is a, c, g, or t
  misc_feature (376)..(376): n is a, c, g, or t
  misc_feature (378)..(378): n is a, c, g, or t
  misc_feature (380)..(381): n is a, c, g, or t
cccattccaccccctccccaatccccccaccccatnaccctttccttttttttatcccctncccttncannncccntcncccccacctcttancnctccttccccttccctacncccaatctnttatttttattctttttttttatcatttttaattaatttttttttatttttttnatatttttaaanncccntnttttatataaaaannaaaaaaagngtgggaagtttnaaaagatttttctttttnnnatnnncttttgatnncctnnnattttttttgtttaattatttttttttttgttttanggttngggtgattnnntantcttctttttttttatattttttttttntttttcccttatccccnttncntnntgccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctcaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310922 - DNA, 179 bp, Homo sapiens
gcggccccctactactactactactgctcgaattcaagcttctaacgatgtacggggacatgctggtcctcctggcccaggctgcaggagccaggctggggggcctccgcacccccttgctgcgtgtgggtaattgtgttttgggggaaagtggggaatttaataaatttctggtgctc

SEQ ID NO: 310923 - DNA, 2126 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggaaaaaaaaacaaaacaaaacaaaaaaaaaaaaaaaaaaaaaaaaaaaaaaaaaaaaaaaaaaaaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310924 - DNA, 2060 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctcaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310925 - DNA, 1878 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctacctgcacgacaacacataaaaaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310926 - DNA, 2238 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgcttcttgctctgttgcccaggctggagtgcagtggtgccatcatgccaacctcgacctcctggacttaagtgatcctcctgcctcaggcccctgagtagctgggactacagtcttgctatgttgctcaggctggtcttgaacccctgagctcaagtgatccaccggcctcagcctcccacaatgctgggatcaccggcatgagccaccacacccagcccgtcttcacaattgtatctgcttcctgtgatgtgaggatgaaacaaaataggattttaagggcccaggacttcacacaccgtaggggtgagctctccattgctgggggaaaccaagcgggccatggctgtggtagggcccttctcggagatcctggccggccttgaccctgaggaccacccctgccccggcccacaggccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310927 - DNA, 2127 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgcttcttgctctgttgcccaggctggagtgcagtggtgccatcatgccaacctcgacctcctggacttaagtgatcctcctgcctcaggcccctgagtagctgggactacagtcttgctatgttgctcaggctggtcttgaacccctgagctcaagtgatccaccggcctcagcctcccacaatgctgggatcaccggcatgagccaccacacccagcccgtcttcacaattgtatctgcttcctgtgatgtgaggatgaaacaaaataggattttaagggcccaggacttcacacaccgtaggggccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310928 - DNA, 2018 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgcttcttgctatgttgctcaggctggtcttgaacccctgagctcaagtgatccaccggcctcagcctcccacaatgctgggatcaccggcatgagccaccacacccagcccgtcttcacaattgtatctgcttcctgtgatgtgaggatgaaacaaaataggattttaagggcccaggacttcacacaccgtaggggccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310929 - DNA, 1762 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310930 - DNA, 1700 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacagtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310931 - DNA, 1393 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaattcccactgtatattttaaaaaacctttttgtttgtataccaaaaaactctccaaccggtaaacatgggtgtagttcccggccgtgctcctcacattttttaaaagagcttgattcccggaggggggttgttttcacctccgatccctgc

SEQ ID NO: 310932 - DNA, 1273 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccgtacgcgcgcacacatatacacacaagatgcattctggcatcagggtacaagggccccagcgacctaacccctcagcgcacagc

SEQ ID NO: 310933 - DNA, 1130 bp, Homo sapiens
gaccgaccacctgtcctgggaggtgtgaatctcaccatcaagaaggactgtgaaggactgatgcccagccagaggcgggcagtggcagactgacggacggacgacggacagggcggatgtgtatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310934 - DNA, 1043 bp, Homo sapiens
  misc_feature (36)..(36): n is a, c, g, or t
  misc_feature (61)..(61): n is a, c, g, or t
  misc_feature (67)..(67): n is a, c, g, or t
  misc_feature (70)..(72): n is a, c, g, or t
  misc_feature (76)..(76): n is a, c, g, or t
  misc_feature (79)..(79): n is a, c, g, or t
  misc_feature (93)..(93): n is a, c, g, or t
  misc_feature (95)..(95): n is a, c, g, or t
  misc_feature (114)..(114): n is a, c, g, or t
  misc_feature (123)..(123): n is a, c, g, or t
  misc_feature (177)..(177): n is a, c, g, or t
  misc_feature (189)..(190): n is a, c, g, or t
  misc_feature (194)..(194): n is a, c, g, or t
  misc_feature (196)..(196): n is a, c, g, or t
  misc_feature (210)..(211): n is a, c, g, or t
  misc_feature (220)..(220): n is a, c, g, or t
  misc_feature (232)..(232): n is a, c, g, or t
  misc_feature (250)..(252): n is a, c, g, or t
  misc_feature (255)..(257): n is a, c, g, or t
  misc_feature (266)..(267): n is a, c, g, or t
  misc_feature (271)..(273): n is a, c, g, or t
  misc_feature (309)..(309): n is a, c, g, or t
  misc_feature (314)..(314): n is a, c, g, or t
  misc_feature (323)..(325): n is a, c, g, or t
  misc_feature (328)..(328): n is a, c, g, or t
  misc_feature (356)..(356): n is a, c, g, or t
  misc_feature (373)..(373): n is a, c, g, or t
  misc_feature (376)..(376): n is a, c, g, or t
  misc_feature (378)..(378): n is a, c, g, or t
  misc_feature (380)..(381): n is a, c, g, or t
cccattccaccccctccccaatccccccaccccatnaccctttccttttttttatcccctncccttncannncccntcncccccacctcttancnctccttccccttccctacncccaatctnttatttttattctttttttttatcatttttaattaatttttttttatttttttnatatttttaaanncccntnttttatataaaaannaaaaaaagngtgggaagtttnaaaagatttttctttttnnnatnnncttttgatnncctnnnattttttttgtttaattatttttttttttgttttanggttngggtgattnnntantcttctttttttttatattttttttttntttttcccttatccccnttncntnntgccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggaaaaaaaaacaaaacaaaacaaaaaaaaaaaaaaaaaaaaaaaaaaaaaaaaaaaaaaaaaaaaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310935 - DNA, 781 bp, Homo sapiens
tgatacgtctccctctttgacttttctgaatctccccactccacctcgtggttctcatctctgtgtctctgattctgataatctgtcctctgtctgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggaaaaaaaaacaaaacaaaacaaaaaaaaaaaaaaaaaaaaaaaaaaaaaaaaaaaaaaaaaaaaaaaaaaaaaaaaaaaaaaaaaaaaaaaaaaagaggggggggccaacattatgtgccgggggcgcgggaacaaagggggtcattgaaatgggccaaggggccaaagcgggtctcccggccccagagttttcttggctcccaagggcgaaacatcagccggggcccccatataagggggcccggaacaaaatcgcggagagcccaggggtaccccggcattaaggaggcgcagaaa

SEQ ID NO: 310936 - DNA, 592 bp, Homo sapiens
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctc

SEQ ID NO: 310937 - DNA, 255 bp, Homo sapiens
gatgataaaaaaggaggaaggctagttcttgggtccccatggtgcctgggggtccccaaatgccaccccggcccagagagcatctgtttccacctagcccagtacctcctgaccctgctggagacagacgggggcctgcctggcctggaggatggggacttggcaccccctgcatcaccaggcatctttgccgaggcctgcaacaacgccacctatgtggaggtgtggcccccaaccccctcactccctccacac

SEQ ID NO: 310938 - DNA, 485 bp, Homo sapiens
ccggtaccatctgtgactccaccacaggctcatggtaacgccgatccgttcacttaatgccgctagcggcgctagcggcattaagtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310939 - DNA, 505 bp, Homo sapiens
ccggtaccatctgtgactccaccacaggctcatggtaacgccgatccgttcacttaatgccgctagcggcgctagcggcattaagtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttccatgccgctagcggggcatgga

SEQ ID NO: 310940 - DNA, 1525 bp, Homo sapiens
tgacctcttcctcgacaggtccagcagactctggaggcccgagcagctgctgcagccacagtagttcctcccatggtgggtggccctccttttgtaggccctgttggcttatggccctggtgagtcggacgtcgacctggactggcccagagggcatcgacggaaggccatagtaccgtgcggcgggcgagctgatggcctcctcctagtagggctcccgtagtcctgacgtcgcaggcgcttcagtccgcccgagcgtgctagcatgagagcgagaattccgggtcgtctcactctgcaagtaagcgcggatgctacggacgcatattgggccgtgaaggacggtgcgtaatgcagtgggactcaagtggggatctccactacataggcgtcgaagacgcgcgcgtaggacatcacgactatagcatcgtgagacaacatacacacgtgacgtgcgaacacgacagtgggctcgcgaagttagagtcattaaactatgggaagccaatcgacggacacacatcatgggatgaaaggcacaggaagcaacgacaggtacaagcgagaagtcactgaatgccaggaaggaaggagaccatggaagaaggcaataaagagataacatagccaagagagcagagctagagcgatgcgcgagtgcccagagtgaccgaagagatggagacaacaaagggagcaacagtgccacctagatgaggaacgataccaaggagaaggtagccacaaatgatgtgcagaacagaagaaggagagaacacagggacagacaaacgagatgacaaaggtagacacatggaaaagagaaggccatcattatgaaccaacacagcgaagaaactagagaggcagcaaccccacacaaggagagagaccaacaacaacaacgaggaaaataatatacaagtaggaacaaaggcgcatggcacacagaggaagaaaataccacgatgggatgtgagcccaaacacgagagaccacaaacagataccagaaagcaccaggagacgacccaccttggcaaaagaaccactaggagaagacgcacaacaaagagacaagaggacaaatgaaaaccaacggaacagaggggaactcccaaagaacaagcgaataaaaatccaaagtcaaaaacagcgaacaacatagaagagaaaacaggaaacaacaaacatagtggatgtacaatataaacaactggtcaccaaacaggaggatacaagggcacaaaacactccccaaaacaacgccgaagacgataatcacgcgacacctcacaagtacaaacgacagacaggcagacacacttagcaacgccagaagtgaacaacacgagcacacgacacagagacaaaagaacagcgaaacagaagcagaagacagcacagacacaagagaagagcacacacgcaagagaacaacacgaattaagaaaacgaaagacaagagggagataacagcgaaaaagaaaaaacacacgacacaccgaacagagaaacaaaacaaa

SEQ ID NO: 310941 - DNA, 1600 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310942 - DNA, 1687 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310943 - DNA, 1689 bp, Homo sapiens
  misc_feature (22)..(22): n is a, c, g, or t
caggctggtacggctcggagtnttgggatccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310944 - DNA, 1989 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaacacaagagcagacaaacaagcaacaaacaaaggggggggggggcgcatccatcgccccccgcggcgcgcccctgccacagcaccaccaccaacaaccgtgataatgaccgcggctgccactcagtaggggaggaagcgtacatacgacagagagtgaagcgggatggtcgcgacaatcacaacagaagagagagagaggacaactagagcggcgctgcgctgacgcttagagcgaggcgagaagcacaagacgagggcgggacgacaccgaatcagcagaaaaccgacac

SEQ ID NO: 310945 - DNA, 1621 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagattccgctctctcctctgcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310946 - DNA, 1555 bp, Homo sapiens
  misc_feature (22)..(22): n is a, c, g, or t
caggctggtacggctcggagtnttgggatccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310947 - DNA, 1618 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310948 - DNA, 1132 bp, Homo sapiens
  misc_feature (1090)..(1090): n is a, c, g, or t
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccgggccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtctggtctggccggccctcgcanacacccagctaaggtttgagtcaaacctggtgaaaaaagagg

SEQ ID NO: 310949 - DNA, 1227 bp, Homo sapiens
tgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310950 - DNA, 752 bp, Homo sapiens
gagaagacgacagaaggggtggtcagtaggagagcacgttcagagggaagagccatctcaacagaatcgcaccaaactatactttcaggatgaatttcttctttctgccatcttttggaataaatattttcctcctttctatgtaaaaaaaaaaaaaaaaaaaaaaaaaaaaagtcgtatcgatgtcgagcgatcatgatgatgatggctgcgagaagacgacagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310951 - DNA, 414 bp, Homo sapiens
  misc_feature (22)..(22): n is a, c, g, or t
caggctggtacggctcggagtnttgggatccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcca

SEQ ID NO: 310952 - DNA, 5179 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310953 - DNA, 3895 bp, Homo sapiens
tctatcctggtttttaaaaaatgtgtctgtggaagtttaatttttatgtagtcacatctcagtttttttccattgcatttattctcagaatgcttctccctgccctgagattagataagcagtcatttgttctttcttgagttattttgagatttcagttttaacattttcttctataatccatgtggctgggttttgggatctggctaacccccgccatgccagtagcctgaggggcccagccccacttgttgaacagccgctctccccgccccacccaccctgcctgcctgcccacccgccctggtctctccaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310954 - DNA, 551 bp, Homo sapiens
gactgtcctcgcagagaatgtgaacatgtgtgtgtgttgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310955 - DNA, 575 bp, Homo sapiens
agagagcagaactcacgctccagggctcagagcaggaggtagggtgtgcggcaagcgctggcccggacagaagcagagtgggccctggtctcgggcaggatgtttctgactcacatttcctgaggagagaaagctaagctctttgcctaatgtctctgtctccccttccagaaaaatgcctcagctcttccggcctgaaggaatggcctcctcccgggccccatgattctttcctgtgtgggccctcctggccctggcctctgggctgaggcttgctagggactcggggtggctctaaggggcagggatagggctggggagcgccggcctgtggccctgaccagccccttctcgtgcaggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccacccggacctcaattaaagatcctata

SEQ ID NO: 310956 - DNA, 5193 bp, Homo sapiens
cgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310957 - DNA, 5635 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcaggtagtgcctttggagaccagtgctgcccgcacacactcccaaggccccgccctgagatttcaggagactgacgcagccttgggaattggccaggggttgtaagggcaggggttgctgtcttcgctttaggatcccagcaatgcactgagtgattgttgctctagttccaaagaattaggaagcatgagtaaatacaaaccaggcatgatgatgcacctccgtcctgaaggtggacagccatgttttcaacgcccaccccaactgtctgcaggggtgccactgtgctgtggcatgtgcggcagagaagagggacttcccttcctaaaataactgtcagagtgacttgcagaactgggtagtttgggttggaaggcccatcctgccattagtgtcaggcccctatctttggagacttgacctgagccactttacgctgttctccacgccgctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgagatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310958 - DNA, 5255 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagagaccatgaaacgtgttggcgtgttgctgaagtgttaagagaagggaccaaaggggatggaactcataccttgcagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310959 - DNA, 4632 bp, Homo sapiens
gatcacttgagcccaggagtttgagaccagtctgggctatgtagggagacctcgtttctacagaaaaaaattttttaattagctgggcaaggtggtgtacgcctgtagtcccagctactcaagaggctgagatgggaggatttgcttgtgcctgcgagtttgaggctgcagtgagccatgatggcgccactgtactccagcctgggtgacagagtgagactgtgtctcaaagaaaaaacggctaggcgctgtggctcacgtctgtagtcccagcactttgggaggctgaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310960 - DNA, 4440 bp, Homo sapiens
ggttactctaaggatcccctcttaccatcacagtgatgattgtcctcgcgacgaacttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310961 - DNA, 5090 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagttgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310962 - DNA, 4182 bp, Homo sapiens
caacttacggctaggtacgaggcctgggtggtgatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310963 - DNA, 5123 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310964 - DNA, 4341 bp, Homo sapiens
caacttacggctaggtacgaggcctgggtggtgatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310965 - DNA, 4061 bp, Homo sapiens
tctgacaggccctgaggctgccctctgaacaggctcggggctgttggctcatgggacccattccctcaccggcagcacaagcaggttggctcctggttacaggaagccgggcttgtgactttactgtctggagcccgaatccctgtgcagggaaaagcttgcttttatcactgcctcatctctgtggggtgacccagccccagaacaccatgtttgtggggccaagatgggccatctctgtccctgtggacccatggaagaccaggcccattcgtctgcccactatcttagcgttttcaaagggctttcacctctgaacccaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310966 - DNA, 3752 bp, Homo sapiens
gaagcttctgaggacagagtaatgtctacgtcccggtaggctttgaatggatgcccttcttctgacttctatacagcttggatgacggacttgtagatcctgaagctgatggtgacagagagaagagccaggatgaggtaagaaaccacactgatgacactgaatgctgccatggtgcacatcaacagggccctgaaactcattattcgtctctttctggtagaagatctggttgactccttgaagctggctgtcttcatgtggcatcgataaacaccggtgtttatcgatgccaccagcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310967 - DNA, 3895 bp, Homo sapiens
atgaggcgcgttctgctttgggccttttgccttaacttgaatgcttctcccctcttcctgcccagtcatctctgtccctgtggacccatggaagaccaggcccattcgtctgcccactatcttagcgttttcaaagggctttcacctctgaacccaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310968 - DNA, 2686 bp, Homo sapiens
gcggccgctccaacacagaatggccatgtgctggggtgcaaagcatgagcgcaggtccgcgtggaactcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310969 - DNA, 5129 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310970 - DNA, 1712 bp, Homo sapiens
tgtccctggtatgtgcaggttgctagggtggtggagctgacaggaggccccccgtcttcaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310971 - DNA, 1575 bp, Homo sapiens
ttacggtacgtcgaccgggcgcgctcgctgtgtactgggtgctccacgaggctccgccggggttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310972 - DNA, 1724 bp, Homo sapiens
agagagcagaactcacgctccagggctcagagcaggaggtagggtgtgcggcaagcgctggcccggacagaagcagagtgggccctggtctcgggcaggatgtttctgactcacatttcctgaggagagaaagctaagctctttgcctaatgtctctgtctccccttccagaaaaatgcctcagctcttccggcctgaaggaatggcctcctcccgggccccatgattctttcctgtgtgggccctcctggccctggcctctgggctgaggcttgctagggactcggggtggctctaaggggcagggatagggctggggagcgccggcctgtggccctgaccagccccttctcgtgcaggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310973 - DNA, 839 bp, Homo sapiens
  misc_feature (15)..(15): n is a, c, g, or t
  misc_feature (19)..(19): n is a, c, g, or t
  misc_feature (28)..(28): n is a, c, g, or t
acaactcgagctcgntacncctaattgnttcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310974 - DNA, 667 bp, Homo sapiens
  misc_feature (52)..(52): n is a, c, g, or t
  misc_feature (75)..(75): n is a, c, g, or t
  misc_feature (81)..(81): n is a, c, g, or t
atctcgactacgtcagtgagttggggcgcccgctgccaacaccaagattggnccccgccgcatccacacagtccntgtgcngggaggtaacaagaaataccgtgccctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310975 - DNA, 3696 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagtggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggtagcggcccgggtgtgggtgccagctatggcacggccagtcctgagggcgaggccaagcttggcttcaggtcagcctcaggtccctggacttccctgatgtcggagtcctcagctgagctgctcacagctttgaggacctgggcagtgaggtcctgagttgccctcc

SEQ ID NO: 310976 - DNA, 3274 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaatgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310977 - DNA, 2632 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgccgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtc

SEQ ID NO: 310978 - DNA, 1635 bp, Homo sapiens
caacttacggctaggtacgaggcctgggtggtgatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgccgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtc

SEQ ID NO: 310979 - DNA, 631 bp, Homo sapiens
ggtacctgtagcacacaacatcataaaaacaactacctaattactaatgatattgagcatcttttcacgtgcttactggccattcgtgtattttctttggagaatgtctattcaatctctttgcccatttgtgaatcaggttatttgtttttatgttgttgagttgtagaagttatttgttctggatattaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaa

SEQ ID NO: 310980 - DNA, 1818 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcatctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggtaatcgtgtatgtatcttgcttctagtggagccacacagccctgcctgggccccctggctgggctggggttgggggagaggtgccagcacctgcttccaacagggtcagacacagggagggcagtgccttctgcaggctggtcctcgcggggggacacatggcaggggtgcctggcctgatgccagctgttgcttgcttggtgaggactcccaattg

SEQ ID NO: 310981 - DNA, 1135 bp, Homo sapiens
cgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaacctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggtaagcttcacctatatcctgcctggggcaatgtctgtggatcagggtcctgggctgtggtctccaccactaaggatgggtgaggacactgctatgtctatcagtattcagaggctggaccttctgtggggtaggcagacactcatggggggcctcccagcacttgacagcccctgggacactttagttcacatctgcataaaaagttcgtgttgttaacaggacattttaaggaacttggcttctttccccaaaaaataaaaaatgtcattggtgtttttgtg

SEQ ID NO: 310982 - DNA, 259 bp, Homo sapiens
cctctctggaacgcacgccctcgccggagcctgttgacaaggacttctactccgagtttgggaacaagaccacaggtacccctgtctagctcaggctgcagacaggctgcctggacagacgtcatgggccccagggtggctctctgtgccccagaaccctctctgcctctatgtctctcttttctcacttagctggccagggttttatgtggggcttttcgatggcagagtctccactccagcagtccctcaaccatct

SEQ ID NO: 310983 - DNA, 497 bp, Homo sapiens
gagcctgcgaggcagaggtggcagtgaactgagattgcgccactgcactccagcctgggtgacagagcgagactccatctcaaaaaagagaaaaggctagaaaaggcatcaccaggtcaccagggcaaaggccctttgggcttgaaaagcattgctcctaaagcagggccaggacttaattctaagtggctgttatgtggtaaattgttcagctttgaacgatttcacaatcgtttaaagacataggaaccaaaggcatgctttaatgcaagtttacttccacatgctaaatatgctccagcccttccttaaattctgcaacgactgtgttcccagtgagtgttgcgtgagggcccgagtgtggtgctccacacagatgtttttatgcaggaagtccttgttcctgaagcctcagaatttgatgagtgggagcctgaaggcacaaccctagaaggccctgtgactgccgtcatccccacttggcaggcattgaccac

SEQ ID NO: 310984 - DNA, 1298 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310985 - DNA, 1387 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggca

SEQ ID NO: 310986 - DNA, 1594 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtaaaaaaaaaaaaaaagaaaaaaaaaagaaaaagaaacaaaaaaaaaaaaacaaaaagaaaaaaaaagagaaaaagaaaaaaagagagagagagagaaaaagaagaaaaaaacacccccccggggggggagcgcgcagcagaaaagagaggcggagctctaaccttacgggggagggcgggcgagaacaaaatgtgtgggcgccatataaaggggggggagaaactcgaacgcggcgggaacaaagagggagaaaaggaccacgggggaaaaaaagattcgcggcgaaacatcccaaa

SEQ ID NO: 310987 - DNA, 1502 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggctggagtgcagtggcacaacctgggctcactgcaacctccgcttcccgggttcaagcgattctcctgccttagcctcccgagtagttgggattacaggcgcccgccaccacgcccgcgcggattcatggaaaatttttaaatctgcatgtactttaaagaaatacttttgagtcggtggactgaacatgactgatgtatatagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310988 - DNA, 1423 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcagtgaatctattctttgaacattctacaacaagaattacattatactgttataccagagtacttctgcagtgtgaaatagattggtttggaaaatgaacctggctttgctataaattacattcacaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310989 - DNA, 1255 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310990 - DNA, 1225 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310991 - DNA, 1299 bp, Homo sapiens
ggcggggccggcggaagcgtggagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggctggagtgcagtggcacaacctgggctcactgcaacctccgcttcccgggttcaagcgattctcctgccttagcctcccgagtagttgggattacaggcgcccgccaccacgcccgcgcggattcatggaaaatttttaaatctgcatgtactttaaagaaatacttttgagtcggtggactgaacatgactgatgtatatagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggaggcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgta

SEQ ID NO: 310992 - DNA, 2047 bp, Homo sapiens
gacagagccttgctctgttgcccaggctagagtgcagcctctgcctcccgggttcaagcgattctccttcctcagcctcccgagtagctgggattacagacatgctccaccacgtccagctaatttttttattttttggtagagacggggtttcaccatgttggccaggctggtctcgaactcctgatcttaagtgatccgcctgcctcggcctcctaaagtgctggattatagcccacccaatcctatttttttaaaatgctgtccattaatgcattctgacttcttgcttgaaaacccctggtttagtggataagcacctgtaactccaggaagattcaggattaagggcagaaataatgaagtaaattgaagtattagcattagtattttccattacattttggaatcgtctattttgatgtattcacgacggttaaaataatttaacatgctaatgtatggattaacttggcaattccattttaaaatattaaatggaataacgattctgactcgtaagtagacatgtgtaacagaattcaaccacatctgtaaaccatattgaaattatgagagtaagatttaccaaccacatttaggtttgacatattagatttgtgagtgaactatgtacttggattttgtcaagtaactcaatcgcttaacaaaataacaattaaatgtataaatgcagtttatagctatacattatttttaaaaatccccttcgaatgactctttaaaacataccaggggatacgctacttaagtataactaggttttggatttataacgttaatattaattattaaagcaaaactcatttctaaagagtcgcctgagtgcccaaaagacgccctcaaggacagggaagcagctgcgattcactcagcgatcaccagcgcccagaattcagggccgcccaagcggaggagcaacacgtggcccagcaaaaggagctgggtcccgtgcagcacagcaacaagaaactggcctaggaagacgctggagcgtctttctttcgcacgttactgcctgctacagtcatttaaaaaaaaaaaaccaaaaacaaaaaaaagaaataaattaatagtacgaagaaaactgcgcgagctacattcccagcagggtctgcgccagagcgcgccaggcaccgctcccgttacgggtgggaggaaaggatgcaccgcccacccggcgccggggaggctcgtccccgagtaggggacgggaacgcctgggtcccggggacgtggggcgcagggtctggggcccgaggccacggacgaagcgggaagccggctaggcagcggtctctgtctgggatggacgccgcgccccacgcggacctcccgccccgacttcacccagctctgctgcccgtaactcatatgacaagaacatcaggaaccggactattaccccgaaagggccttcccaagtcgtttcgccgcctgcagtgcccgaccgggggccgcgcgtccccggcaaccacgcccgcccgcgcagctgcagaggccggaaaaggcccgctcgcccgcgctcggcaccacccagcccgcgctccgggcgataccaccctgggcggcccctccaaaggccggagatggtgtcgtccccggcctccgattggtcgggggggcgggggcgtggcctctggagcctggttccgcgcgccggagcgcgctagccgcattgcgagccgaacccgggagctggcgccatggtgaggagtggttgcggggcgcgggcgacgcgacggtgggggtttcggcctgcgttcgggccgcagacagggcctgggcctgggcctgggcctgcgcctgcgcctgcgcctgccctgggaacgggttccggcagacgctgaggttgcgttgacgctcgcgccccggctcccgttccaggtgctgttgcacgtgctgtttgagcacgcggtcggctacgcgctgctggcgctgaaggaagtggaggagatcagtctgctgcagccgcagaggtgggtgagatccgtgggctcctttggcggccccgcagaccctcatc

SEQ ID NO: 310993 - DNA, 937 bp, Homo sapiens
  misc_feature (799)..(799): n is a, c, g, or t
  misc_feature (801)..(801): n is a, c, g, or t
  misc_feature (858)..(858): n is a, c, g, or t
aaggtcaggtacaggcctgggtggtgcggcagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatggcntngacttatctggcattgactggttaacatcgagagcttcccgacggtggggcctaatngaacgccgactagcactactggcgccagataaccattgccgacgtactatgggaacgccgcgatcaaactcgggcacaa

SEQ ID NO: 310994 - DNA, 1923 bp, Homo sapiens
ggatccggcaacgaaggtaccatggcgggacgtggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 310995 - DNA, 2101 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 310996 - DNA, 1921 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 310997 - DNA, 2097 bp, Homo sapiens
  misc_feature (6)..(7): n is a, c, g, or t
  misc_feature (23)..(23): n is a, c, g, or t
  misc_feature (32)..(32): n is a, c, g, or t
gtggcnngtcgaggctgggtttnaattcggcngagggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 310998 - DNA, 2287 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccaggtcagcgacattggatgccttccctctgcctctgggagctatgggttggcatgcattggggtagagatccaatctggcctgaggctcactcaggacttcggggtgagaggaggggaggagctgagctgccttggctaatggggttgaaatttctgatcttaaactctccactgaatattctctcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 310999 - DNA, 2633 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311000 - DNA, 2479 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311001 - DNA, 2106 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311002 - DNA, 2818 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311003 - DNA, 2268 bp, Homo sapiens
  misc_feature (1)..(1): n is a, c, g, or t
  misc_feature (8)..(8): n is a, c, g, or t
  misc_feature (1948)..(1948): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaagacagaaaacaaaaaaggggggcgcaaanatcccgggggccaaataagggaccacgtctgcaaagggccaaagaacggataaaacgcggacacggacgcggcattaaacacgctggcacgggcaaacagctggcaggggacccggctaagaagccctcaactgtggcgggagcaagtgcggagacccacgcaacaaaccccggaagagaaacacggacagcgcacacgcactagtgccggaaggcagcatacaacaacaacagcagacaacacagacgagagacagcacgcaggacaacgacacgtacacgaagacagatcgagacaacagtcaccacgtagcatagct

SEQ ID NO: 311004 - DNA, 1807 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311005 - DNA, 2659 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311006 - DNA, 1958 bp, Homo sapiens
  misc_feature (1)..(1): n is a, c, g, or t
  misc_feature (8)..(8): n is a, c, g, or t
  misc_feature (1635)..(1635): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcgggccctttgggggggnccccaaaagggccccaaaccagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311007 - DNA, 2037 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311008 - DNA, 2335 bp, Homo sapiens
  misc_feature (6)..(7): n is a, c, g, or t
  misc_feature (23)..(23): n is a, c, g, or t
  misc_feature (32)..(32): n is a, c, g, or t
gtggcnngtcgaggctgggtttnaattcggcngagggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaagacctgaatgcagttgttcccatggctgggccaggctttgcagtgatgacttgcgaatcaaatctgtcaatcccctgagtgcaatcactgatgtctccatgtctctgagcaatgcctgatggggagggatctaggtatgccatcccagcgtgctcggtgggaccagggtagtcagctgagggatgttagagttgatcgtccttcagcctgttagtgggaactgtgttctttcccctgaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311009 - DNA, 2230 bp, Homo sapiens
  misc_feature (6)..(7): n is a, c, g, or t
  misc_feature (23)..(23): n is a, c, g, or t
  misc_feature (32)..(32): n is a, c, g, or t
gtggcnngtcgaggctgggtttnaattcggcngagggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaagacctgaatgcagttgttcccatggctgggccaggctttgcagtgatgacttgcgaatcaaatctgtcaatcccctgagtgcaatcactgatgtctccatgtctctgagcaatgcctgatggggagggatctaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311010 - DNA, 2217 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311011 - DNA, 1959 bp, Homo sapiens
  misc_feature (6)..(7): n is a, c, g, or t
  misc_feature (23)..(23): n is a, c, g, or t
  misc_feature (32)..(32): n is a, c, g, or t
gtggcnngtcgaggctgggtttnaattcggcngagggtgctgttgcacgtgctgtttgagcacgcggtcggctacgcgctgctggcgctgaaggaagtggaggagatcagtctgctgcagccgcagctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311012 - DNA, 2033 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311013 - DNA, 2381 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggaaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311014 - DNA, 2312 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggatgaaagcctgcaagtagactatacagaagcctcaggaggtgacgcagtgatgcatggtacgatgacgccatgctatgtaggattttctgagaccaaagaaagaggaatggtgtagggtcgagtagaaggtcatgatttgctctc

SEQ ID NO: 311015 - DNA, 1796 bp, Homo sapiens
  misc_feature (6)..(7): n is a, c, g, or t
  misc_feature (23)..(23): n is a, c, g, or t
  misc_feature (32)..(32): n is a, c, g, or t
gtggcnngtcgaggctgggtttnaattcggcngagtgggaactgtgttctttcccctgaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggggtcagtgcagagcctggcaacctgcataaggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 311016 - DNA, 1741 bp, Homo sapiens
  misc_feature (1)..(1): n is a, c, g, or t
  misc_feature (8)..(8): n is a, c, g, or t
  misc_feature (1640)..(1640): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccagagccctgaagacaaggggtaacaccccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgagagangagtgaaaaacccaaaaaaacacccaccccacaccccaccacacacacaacccacacacaaaccaccccaccacccccccaccccaccacccccccccacc

SEQ ID NO: 311017 - DNA, 1142 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagcctgaagacagggtacactccaaaattgggctccttttcatccacttcatggcgagcgtgcccaaacaaggcgttccgatccgggaaagcggt

SEQ ID NO: 311018 - DNA, 1014 bp, Homo sapiens
  misc_feature (1)..(1): n is a, c, g, or t
  misc_feature (8)..(8): n is a, c, g, or t
  misc_feature (799)..(799): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatggtgganttttgcctggttgtaactcggagctctccgcggggggctatcgaaaccgcaactagactacgcgcccgagaggcaagagccaactcgccacggggagggagcggtcatcgatggacgcacacgccagtacacccaagtgggcgagcgcgcaaagagcacatgaccccggcgagagacacgagcatgcgccggcactactagaaccacccgggcgg

SEQ ID NO: 311019 - DNA, 934 bp, Homo sapiens
  misc_feature (1)..(1): n is a, c, g, or t
  misc_feature (8)..(8): n is a, c, g, or t
  misc_feature (796)..(796): n is a, c, g, or t
  misc_feature (798)..(798): n is a, c, g, or t
  misc_feature (855)..(855): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatggcntngacttatctggcattgactggttaacatcgagagcttcccgacggtggggcctaatngaacgccgactagcactactggcgccagataaccattgccgacgtactatgggaacgccgcgatcaaactcgggcacaa

SEQ ID NO: 311020 - DNA, 1008 bp, Homo sapiens
  misc_feature (1)..(1): n is a, c, g, or t
  misc_feature (8)..(8): n is a, c, g, or t
nggccggngtgaatcggacgaggcgggagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatggtcccgtctccctgggctggctttctgcctgctgtacatcggagcttcccgcggtggggttatttgatacgccgagctcacccttcgggcccattgtactgcccccttgccattggggggggggctctcccgtgcgccccccggtttcccggctctttggccgcccaggggcagttttccctctggaggactccagcattctcgttcgctacgct

SEQ ID NO: 311021 - DNA, 557 bp, Homo sapiens
ccaaaatatggactcattttccactccaccttcattggccgagcagctgccaagaacaaaggccgcatctcccgatacctggcaaacaaatgcagtattgcctcacgaatcgattgcttctctggtatgggtgggggggcgttggcaggtgtgagaaggggctgggtggctgggtggggaggcttgcaaccatagcttccacaatgatggcaatatttttcgtcaacagcagttcacctagtgagtgttgagactctgggtctgagtgaagctgagggtagagggaacacagggttggggtagtttctctctttgggctgacaggctttgtcacccacacacatccagaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggc

SEQ ID NO: 311022 - DNA, 485 bp, Homo sapiens
acgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggggtcagtgcagagcctggcaacctgcataaggtatggggctctaaatagctggcctcttgcattcacacttggtttttcctaggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcgcggtgcgtcacaggggactcaaaaatgggagaataaggactgttgccatgtgcacctgcactgctgtat

SEQ ID NO: 311023 - DNA, 309 bp, Homo sapiens
cccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctcc

SEQ ID NO: 311024 - DNA, 3136 bp, Homo sapiens
gaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacccggaattc

SEQ ID NO: 311025 - DNA, 3217 bp, Homo sapiens
gaagagggcgcgagggtagcagccagagggagccgccagccctgcctgcggatccccgccgggcgcatggggcgcttcgagccgggactgcgtgcgggccccgaggccagtttcctgctgtcgtaagaagccgcgccaggacgcccgccggaccccgagctgctgggaggatgaccatggctgggggcaggaggggactagtggcccctcaaaacacgtttctggagaatattgttcggcggtccaatgatactaattttgtgttggggaatgctcagatagtggactggcctattgtgtacagcaatgatggattttgcaagctgtctggctatcacagggcagaagtgatgcaaaaaagcagcacctgcagttttatgtatggggagctgactgataaagacacgattgaaaaagtgcggcaaacatttgagaactatgagatgaattcctttgaaattctgatgtacaagaagaacaggacacctgtgtggttctttgtgaaaattgctccaattcgaaacgaacaggataaagtggttttatttctttgcactttcagtgacataacagctttcaaacagccaattgaggatgattcatgtaaaggctgggggaagtttgctcggctgacaagagcactgacaagcagcaggggtgtcctgcagcagctggctccaagcgtgcaaaaaggcgagaatgtccacaagcactcccgcctggcagaggtcctacagctgggctcagacatccttccccagtacaagcaagaggcaccaaagactccccctcacatcatcttacattattgtgtttttaagaccacgtgggattggatcatcttgatcttgaccttctatacagccatcttggtcccttataatgtctccttcaaaaccaggcagaataatgtggcctggctggttgttgatagcatcgtggatgttatctttttggtggacattgtgctcaattttcataccacctttgttggaccagcaggggaggtgatttctgaccccaaacttatccgcatgaactacctgaagacgtggtttgtgattgaccttctgtcctgtttgccatatgatgtcatcaacgcttttgagaacgtggatgaggttagtgcctttatgggtgatccagggaagattggttttgctgatcagattccaccaccactggaggggagagagagtcagggcatcagcagcctgttcagctctctaaaagttgtccggctgctccgtcttgggcgagtggcccgtaagctggaccactacattgaatatggagctgctgtgctggtcctgctggtgtgtgtgtttgggctggctgcacactggatggcctgcatctggtacagcattggggactatgagatctttgacgaggacaccaagacaatccgcaacaacagctggctgtaccaactagcgatggacattggcaccccttaccagtttaatgggtctggctcagggaagtgggaaggtggtcccagcaagaattctgtctacatctcctcgttgtatttcacaatgaccagcctcaccagtgtgggctttgggaacatcgccccatccacagacattgagaagatctttgcagtggccatcatgatgattggctcacttctctatgccaccatcttcgggaatgtgacgactattttccaacagatgtatgccaacaccaacagataccatgagatgctcaacagtgttcgggacttcctgaagctctaccaggtgccaaaaggattgagtgagcgagtaatggattatattgtgtccacttggtccatgtccagaggcattgacacagagaaggtcctgcagatctgccccaaggacatgagagccgacatctgcgtgcacctgaaccgcaaggtgttcaaggagcacccggccttccggctggccagtgatggctgcctccgggcactggccatggagttccagacggtgcactgtgccccaggggacctcatctaccatgcaggagagagcgttgacagcctctgctttgtggtttctggctccctggaggtgatccaagatgatgaggtggtggccattctaggaaaaggagacgtgtttggagatgtgttctggaaggaagccacccttgcccagtcctgtgccaatgttagggccttgacctactgtgatctgcatgtgatcaagcgggatgccctgcagaaagtgctggaattctacacggccttctcccattccttctcccggaacctgattctgacgtacaacttgaggaagaggattgtgttccggaagatcagcgatgtgaaacgtgaagaggaagaacgcatgaaacgaaagaatgaggcccccctgatcttgcccccggaccaccctgtccggcgcctcttccagagattccgacagcagaaagaggccaggctggcagctgagagagggggccgggacctggatgacctagatgtggagaagggcaatgtccttacagagcatgcctccgccaaccacagcctcgtgaaggccagcgtggtcaccgtgcgtgagagtcctgccacgcccgtatccttccaggcagcctccacctccggggtgccagaccacgcaaagctacaggcgccagggtccgagtgcctgggccccaaggggggcgggggcgattgtgccaagcgcaaaagctgggcccgcttcaaagatgcttgcgggaagagtgaggactggaacaaggtgtccaaggctgagtcgatggagacacttcccgagaggacaaaagcgtcaggcgaggccacactgaagaagacagactcgtgtgacagtggcatcaccaagagcgacttgcgcctggacaacgtgggtgaggccaggagtccccaggatcggagtcccatcctggcagaggtcaagcattcgttctaccccatccctgagcagacgctgcaggccacagtcctggaggtgaggcacgagctgaaggaggacatcaaggccttaaacgccaaaatgaccaatattgagaaacagctctctgagatactcaggatattaacttccagaagatcctctcagtctcctcaggagttgtttgaaatatcgaggccacagtccccagaatcagagagagacatttttggagccagctgagaggtctatttaaaaaaaaagtcagagacagatacctccaaccctgccgtcaccaccacccctaccacccggaattc

SEQ ID NO: 311026 - DNA, 2863 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaaaaaaaaaaaaaaaaaaaaaaaaaaaaaagaagagaaagaaaagaagaaaagaagaaaaaaaaaaaaagaaaaaaaaagaagaacaaaaaaaaaaaaaaaaaaaaaacaacaaagagaagaacaaataaaaagagaagaagagagagagagaaaaagaaaaacaaccaacgagccacaaaagggaaaaacaacctcgagaaacagccgacagagtcgcaagaaataaaggaatctcacgacaaaagacacgacataaaaccacaaagcgagggcagagagggaggagcggagaaaaaaaagagcagaaacgagagaggagacacaaaagacacaaacggcaccaactaagagagcgaaaacgaacgtacaaagacggcgagagacgcagacaaggcacaacggagcagagacaaacgacacagaaaaagaggaaacaacaacacgggagacagtgacaaagaacggacaaaataatatggagaaagagaacagtgtaagcagagatgaaaacagcgagaccaaaaaaaatgggaacggggagagaaagagaagcgaacggaaaggaagagaaagaaaacaaaacgaagcgacagcatacaacaccaggcacaggacaaagaagaagaagagga

SEQ ID NO: 311027 - DNA, 2231 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311028 - DNA, 2037 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattt

SEQ ID NO: 311029 - DNA, 3246 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacctgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311030 - DNA, 3017 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311031 - DNA, 2197 bp, Homo sapiens
accttgtgttctgcctgcctcggcctcccatagtgctgggattacagatgtgagccaccgcacccggcccctctcacccttttcctcaatccaaagatggaactgccagtgatttgaggaagtaatagaaactactaatagaaagcacatataactctgatttttagaggctcgtgtaacctaactagaagtagtacaaacgtgctggtgagaagtacctcagcctggttatctctgggtagtccttattccaggaatatgttttaatccaccgtttgcctttaaagagtcttcccaattgtgactctccccttcccactcttctgctttactccactgccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311032 - DNA, 1850 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311033 - DNA, 2121 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaagaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311034 - DNA, 2579 bp, Homo sapiens
cgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagtaggc

SEQ ID NO: 311035 - DNA, 1928 bp, Homo sapiens
tgtttacattgtcaggctgcattgccactagggggaaccatagctttttatcatcccagccaggtggctgtgggcagcttctgcctggcagatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311036 - DNA, 1183 bp, Homo sapiens
tttatataagcatttttaccatcagaagaagtttttaaaaaagtattatttcctgacatttttcagtactttgtagagaagtctctgataatctcatctctcccaggctaaaagcaatgattgtagtttaaatctgcagctactctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 311037 - DNA, 163 bp, Homo sapiens
agaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggc

SEQ ID NO: 311038 - DNA, 470 bp, Homo sapiens
tcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaa

SEQ ID NO: 311039 - DNA, 650 bp, Homo sapiens
ccactagggggaaccatagctttttatcatcccagccaggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacggggacgggatcgctgctttccccactctctgtccccatgcctcctgggcctcagggtgcagtcaagccctgtctgtctcgaggcttcctcctccctcccgttccacagagctgttctggcaggggcctggagtccagagccgcagcttcgtccctttcggggggcctcagatcgctctgctgctgcccttttcctctg

SEQ ID NO: 311040 - DNA, 407 bp, Homo sapiens
tgccagaacaagtttttacaggacccatgttaactgataaccactgtaagatgacaaacaggcatattaagagaattcatacgctgtcgcatgtgcaagcctcctaatccctcactgtgccctctaaaaggaaggccgtctctgaatcagctgctgatcaccctgctctcttttgtacgtaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaagtgagtgcccaagcttggaaggcacaatgaagtgctcactcgggctgactgtgag

SEQ ID NO: 311041 - DNA, 397 bp, Homo sapiens
gatctagaggaccctttaaatgctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311042 - DNA, 3774 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311043 - DNA, 3602 bp, Homo sapiens
gaattccggtaagaagctctcacaaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311044 - DNA, 4247 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctcaaaaaaagccacaaccaaaaccaaaagcacacacaacacaacacacacccccgcccaacaagacaccaacgaacaacaccaaaaaaccgcgggcgccgcccccacaaagcatctacccgcggggcgcggccccacaactcacgcgccgcccccccgcttcgtcgggcagccagaggcggccccccagtgacgcgaggccccatacacacaaagcagcaggcgcacggccgcgaccacctccaccaaccaacgccgcccgagggagaccaaccacgcccacacgcagcccatcatcgggccaagcacaccccaccatatcctcgggcgggcgcacactccggcgcacacaccccagcacggacaacgcgcccgcagcatacaaaacgcgcacggcgcgttgtgcgtacccacccccaacctagccccggcagacacagcgccaccgacagcagcaacattacaccggcacgcgc

SEQ ID NO: 311045 - DNA, 3823 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagcatggtgatggggcccctggtggcctaccccatgtcttctctccccagaaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311046 - DNA, 3619 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311047 - DNA, 3509 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311048 - DNA, 3580 bp, Homo sapiens
gaattccggtaagaagctctcacaaaatgtgagagcttcttgccgccagagttccgctcttttgctgtagatccccagatcacctcgctcgacgtgttgcagcacatcctcatccgagcctttgatttgagtgggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 311049 - DNA, 714 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccaccccgtcgggtggagcggtacgagctcgatcgtacttaggggggttcaca

SEQ ID NO: 311050 - DNA, 569 bp, Homo sapiens
ctagaggatcccgctccacccgacggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattca

SEQ ID NO: 311051 - DNA, 369 bp, Homo sapiens
gaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaaatgtgagagcttcttgccgccagagttccgctcttttgctgtagatccccagatcacctcgctcga

SEQ ID NO: 311052 - DNA, 1928 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311053 - DNA, 913 bp, Homo sapiens
  misc_feature (12)..(12): n is a, c, g, or t
  misc_feature (731)..(731): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacgancaagcaagtccagtgttccaagagtattcacaggactcgggatcaccgtgtttgctttcactgggagaacagtgacggtacatacaagattgagagggacgaaggttaataaaaggggagtgggaaaaagtgggcaaactggcggggatagacatacacacagatcgaacacatatatattg

SEQ ID NO: 311054 - DNA, 1375 bp, Homo sapiens
aaactttaaagagattatcaaacgaatgcctaggtctttcagaattgtcaatggccagagaaagggtactggctatttttctcctacggtccctttccctatgagaactcactaattttgcagttacctctgtacccgttttaatattgagattaacaagagagagaagctgagtctggcttataagataaagacttttgggagtctatgggccctgctctgtcccagctctgcctcaccttctattggtggacttcagctggctgcaccctctgggaacagtttcacctcaaaccccaggctcccagtgcctgacccagggagggagaagcatcttttatcctgagttttctctaacctgccttttccatgagtgattgatacctgaaatttccacatccttttaagacagactgttaaaacctgtaggttaaataaccggacacagtgacacacacctatagtcacgctacttgggagtctgaggtgggaggatcagttgagccagaagttcgaggctgcagcctgctgtgatcacacctgagaagagcactgcactccagcgtgggcaatacagtgagaccctatatttaaaccaaacaaccaaaaaaacttctaggctaaacatatctgcatctgtcacagtaacaccaacacagaagataaacacagaccactgtggtagcgtggttcatctcattacatgctgctacatgattaaaagtgatgggcatggttttctgttttgcatagacttagagcctgtacattctttctatgaagatttttcccgtgggatttccccccatttacccaataattcattcataataaacagttgttgaacctagataaaatacacctctgtctcttcccatttgcctataagtttcttgccaagatgtgatacagcagctcaaagaatgcttgccaagtcactaatagtctttgctctctctagttcagtgactttccgatactgtgtaacattcagggcactatgtgaacttgtaagtgtgaccatactgcatgttttatggtgacctggtccagtactgcctttgttaaagcatctgtcatcagtaagagatgataagttttttgcacaacagtgaaaaccccacctttaagcatatgattacgcttaataaatattttattaaaaggaaaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgaagcgtggaagaaaccctccgcttgggcccactgggagatcgttggtggaattc

SEQ ID NO: 311055 - DNA, 884 bp, Homo sapiens
  misc_feature (847)..(847): n is a, c, g, or t
  misc_feature (851)..(851): n is a, c, g, or t
gcagcggggtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacggaatggaccggtttcctagataagcagtcagtgttccaaagcttcgaagggatcggatacccggtttggctttcaggggaaacaccggagaccgcttatccaggttgnggcngcccccgtctcacatcacatcggtgtgggacca

SEQ ID NO: 311056 - DNA, 880 bp, Homo sapiens
  misc_feature (814)..(814): n is a, c, g, or t
gcagcggggtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggaccggatttctagataagcagtcagtgttccaagagtcttcgagggaacggaaccccggttttgctttccacgggaanacccgggaccggttcactcagaggtggaagggcccgtttccccagggggcggacccaagggggacc

SEQ ID NO: 311057 - DNA, 1593 bp, Homo sapiens
gcagcggggtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311058 - DNA, 897 bp, Homo sapiens
  misc_feature (741)..(741): n is a, c, g, or t
  misc_feature (743)..(743): n is a, c, g, or t
  misc_feature (750)..(750): n is a, c, g, or t
  misc_feature (761)..(761): n is a, c, g, or t
  misc_feature (770)..(770): n is a, c, g, or t
  misc_feature (775)..(775): n is a, c, g, or t
  misc_feature (777)..(777): n is a, c, g, or t
  misc_feature (793)..(793): n is a, c, g, or t
  misc_feature (800)..(800): n is a, c, g, or t
  misc_feature (806)..(806): n is a, c, g, or t
  misc_feature (808)..(809): n is a, c, g, or t
  misc_feature (811)..(811): n is a, c, g, or t
  misc_feature (895)..(896): n is a, c, g, or t
gcagcggggtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacacntnagcagcngggtccagagnctcgagganccggnanccggtttgcctctggnaaacacngacgcntnntncaggttggggggcctgttaaccaggttggtcgtacacaggcgcattccggctctttctttcttccccataatttatcttttttnnc

SEQ ID NO: 311059 - DNA, 1559 bp, Homo sapiens
  misc_feature (12)..(12): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311060 - DNA, 1952 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311061 - DNA, 1952 bp, Homo sapiens; identical to SEQ ID NO: 311060

SEQ ID NO: 311062 - DNA, 1920 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311063 - DNA, 2272 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccaaaaaaaaaaaacaggacaagagagaagcaagagagaaaaaagaagggcccgcgcacacagaaagtcgaggaacacagccacgaactacagacagcaggccatgggagtcacatgagcccagcagcaacacgagagaggatgggcggcaggaatagacagtcacacgcaacacgaaaggtatgacaataaaaaacccaagaaccagcgagtcagccgagacacgcacgggagttcgctaggaggagacgcatcaagcgaagagatgacgtcgcataggcaaaagcgagcaaggacaagcgcagaaacgtacggcgtcacac

SEQ ID NO: 311064 - DNA, 2083 bp, Homo sapiens
  misc_feature (2009)..(2009): n is a, c, g, or t
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccacaaaaaaaaaaaaaaaaatttggggcccgcccaaaaatttaaacaacgttggcgggnccagagaatggcagccaaaccgccacgcggggtccccaaaaccggacggctggaaacacaggggcggtaacggg

SEQ ID NO: 311065 - DNA, 2248 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccacaaaaaaaaaaaaaaaaaaaaaaaaaaaaaaaaaaaaaaaaaaaaaaaaaaaaaaaaaaaaaaaaaaggggcggcgcgcacgcacaaaaaactaccccgagggggcgcccaacaaatacgcaccaccaacgcatgtggttgaaaacaagggtcgcccaccaagtagtgagtgattaaattaacgacagcgaagagcgacggtgtataaaaacaggcgaggcggaggaaacacgcgccgaggcacacattgaggagaggaacctatagtgagtggggcaagataggggaaacacagc

SEQ ID NO: 311066 - DNA, 1462 bp, Homo sapiens
taagcggatcgtgctgaatcaaaatccacgatggatgttctgatggtcacttagctggagtctactcaatcaggagtccaatagctgaactcgatatcacatttatggccctcgccatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311067 - DNA, 2074 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccaccaaaaaagaaaccaaaacaacaaacaacgcacacacacttgggggggcgcccccggggccccccagaagaagttttaaaaaccaatctcggtggggcggcggggcccccacgaggagacgc

SEQ ID NO: 311068 - DNA, 2046 bp, Homo sapiens
  misc_feature (1950)..(1950): n is a, c, g, or t
  misc_feature (1955)..(1955): n is a, c, g, or t
  misc_feature (1961)..(1961): n is a, c, g, or t
  misc_feature (1964)..(1964): n is a, c, g, or t
  misc_feature (1973)..(1974): n is a, c, g, or t
  misc_feature (1982)..(1982): n is a, c, g, or t
  misc_feature (1988)..(1989): n is a, c, g, or t
  misc_feature (1994)..(1994): n is a, c, g, or t
  misc_feature (1997)..(1997): n is a, c, g, or t
  misc_feature (2003)..(2003): n is a, c, g, or t
  misc_feature (2006)..(2006): n is a, c, g, or t
  misc_feature (2012)..(2012): n is a, c, g, or t
  misc_feature (2019)..(2019): n is a, c, g, or t
  misc_feature (2021)..(2021): n is a, c, g, or t
  misc_feature (2025)..(2025): n is a, c, g, or t
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattatattcttggtgagtttctgggaacattcaaataactttttagaaaaaaaaaaaaaaaaaaaatgggggggngccanaattanaangtggggggnnagagaaanggaggnnagaanggnaagggntcncaaaanggggggnancagntgttttaagtactcgtgggat

SEQ ID NO: 311069 - DNA, 1924 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattagtatgtcttacaatgaatacttcagcaaagaaaataattataatt

SEQ ID NO: 311070 - DNA, 874 bp, Homo sapiens
  misc_feature (12)..(12): n is a, c, g, or t
  misc_feature (837)..(837): n is a, c, g, or t
  misc_feature (841)..(841): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacggaatggaccggtttcctagataagcagtcagtgttccaaagcttcgaagggatcggatacccggtttggctttcaggggaaacaccggagaccgcttatccaggttgnggcngcccccgtctcacatcacatcggtgtgggacca

SEQ ID NO: 311071 - DNA, 1504 bp, Homo sapiens
  misc_feature (12)..(12): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaatttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311072 - DNA, 1338 bp, Homo sapiens
  misc_feature (12)..(12): n is a, c, g, or t
  misc_feature (1338)..(1338): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaacatttacttatttattaatagtcttggtatgatattcn

SEQ ID NO: 311073 - DNA, 1945 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagtagagacggggtgtctccatgttggtcacgctggtctcgaactcctgacctcaggtgatccgcccaccttggcctcccaaagtgccggaattacaggcatgagccaccacacctggcctactcaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311074 - DNA, 1786 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311075 - DNA, 1896 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311076 - DNA, 1459 bp, Homo sapiens
  misc_feature (12)..(12): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttcggctggaagatggttctggcttcattttccatacaaactttttcaaatagctagtcaagtaaaaatttacctgttctaaagatgaggccaggcacggtggctcatgcccgtaatcccagcactttgagagcgtaaggtgggaggatcgcttgagcccaggaggtggaggctgcagtgagccgcgattgcaccactgcactccagcctgggtgacagagcaagactctgtctcaaaaaaactagttttcttttttataatatttattgggtactatccttttaaaatgtcccgttgaaaagctggggtcccgagc

SEQ ID NO: 311077 - DNA, 1563 bp, Homo sapiens
  misc_feature (12)..(12): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctatcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccatttctataagtaatattgtacttcaaaatacaaaaaatatctcgagactagttctctc

SEQ ID NO: 311078 - DNA, 870 bp, Homo sapiens
  misc_feature (12)..(12): n is a, c, g, or t
  misc_feature (804)..(804): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggaccggatttctagataagcagtcagtgttccaagagtcttcgagggaacggaaccccggttttgctttccacgggaanacccgggaccggttcactcagaggtggaagggcccgtttccccagggggcggacccaagggggacc

SEQ ID NO: 311079 - DNA, 1384 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcgtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311080 - DNA, 863 bp, Homo sapiens
  misc_feature (20)..(21): n is a, c, g, or t
ggtcgactctcgaggatttnncgatcggctagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311081 - DNA, 987 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagactggctctcataattgccctggagtcatcgc

SEQ ID NO: 311082 - DNA, 1133 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacgaatttcttcaacgtcctgggcaccgtttctcctcgagcaagcaagtcaagtttttcaaagagacttg

SEQ ID NO: 311083 - DNA, 1100 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtttctcaatatccgacccccaaggaggaatcaagccattgaagcggtaacgctctccagtgcgctcgggggggctagcaacccgtcgcctcgtggaggttgtcccttttgttaaacatatgtgtattctgcccagcgccttgcccacggttcttttacttccatccttttcatt

SEQ ID NO: 311084 - DNA, 1080 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagtcaaccgctcggtcctcgtctaaatggtctttttacagctttacctacggcatcttacagcatttcgtctccatgtgctccaaatggtctatcctgtcacaaatcttcgcttgcccatccgtccccgctcccatgctccctatactctagctacctc

SEQ ID NO: 311085 - DNA, 1113 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggccagttgtcgcttttagtgccaacgctaacgcctttcactgatgtgatctgtgtagtttgttgtagtttcattggattcccactttagcccttccgcctggttacactcaccaggactgaatgttggtttgagccctttgtaccattgactattttcaggcgttagctagtcgattttcctgagcctccggcctttcgtcctccatggtctcccccccttgcctccatgagtccctctccattctttcccccacctggcggcgctcagccttttgatcgcgccactcatcctctacctgccccccaactcttcttgatacctctccgcttgtttatggttttttcaattttccactctcttgacgctggcttctcatagaatctattctttttgtcttttcgcgtatagcttattcgttcctctcacctccca

SEQ ID NO: 311086 - DNA, 611 bp, Homo sapiens
  misc_feature (588)..(588): n is a, c, g, or t
  misc_feature (598)..(598): n is a, c, g, or t
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccaggccgcttttttttntttttttttnttttttttttttg

SEQ ID NO: 311087 - DNA, 1899 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311088 - DNA, 1423 bp, Homo sapiens
  misc_feature (12)..(12): n is a, c, g, or t
actgtaggctangtacgggctggtgggcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttcaagcttctcaacgcttggtcttgtcccattcttcacgaatttatttattctttgtctaaacaggtataggatcttcttagtctaacaggtatagttaagggttttcattctcttgtgaaggctcctatatatatttaaaaattaggcaagatttgaatgctttttttctaggtcttgtccaattcttcacgactttatttattcttagtctaaaaggtataggatcttctttgtctaaaaggtatagttcacggtttacattctcttgtgaaggctcc

SEQ ID NO: 311089 - DNA, 2054 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagtagagacggggtgtctccatgttggtcacgctggtctcgaactcctgacctcaggtgatccgcccaccttggcctcccaaagtgccggaattacaggcatgagccaccacacctggcctactcaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311090 - DNA, 1795 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311091 - DNA, 1653 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcgcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgtccagtatgttgaaccctggggaagtctgccgaatggacatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 311092 - DNA, 993 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaaggcaccgagcatttgagccccaactatttcccagtgggc

SEQ ID NO: 311093 - DNA, 1084 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaaggtaagatcctgtttctgatgaacttaagattatttttcatgtttagtatcattctgcttcttaggggatttatgtagaccttggtaaagcatttttaaaaccagaagatcctggctgggcatggtg

SEQ ID NO: 311094 - DNA, 1200 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagggtatggcattgtacccctagcttttgctcttataaacttgtttggaagaatctaaatttctagctatgctgctggactatcaagatcaaattacgcaagggttgggttttttttgttttttttttttgagacggagcttcactccagcctgggcgacagagcgagactccatctcaaaataaataaataaataaataaaataataaagaattagaaaaagcatctgtagtcccagctactcaggagactggggtaggatgattgcatgagcccaggagtttgaggctgctgtgagctgtgattgcatcactgcattccagcctggtgacagcgagactctgtgtctta

SEQ ID NO: 311095 - DNA, 989 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccacatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagtgacaagatggcggtttggtccatatttacattcgacttcttgcagacttacctaagaacatttccgggacctagtttagctggtagatggtttagtcttgaacttaaaggttgcttcataatgtccctattgtggtcatatatcattttaccgtaccgttttcaattat

SEQ ID NO: 311096 - DNA, 982 bp, Homo sapiens
ggcacgaggctttacatgagtttttaaatcctattttaaaacataaaagaaacaaatccatcattggccgcacagccccagccaccgccccccaaccagggagcaagaggagacgcctgggtcctgttccgcacgcggatttgctggtctgtttaactggtgtccattctcgcattataggcgtccagctgggcatccagctcctctgccgaaagctgctgctttgaattcctgccggcacctctgcctcttccacgggcgcctccgcgggtgcctctccgggtgcctccaccaccaccaaaacctccagcgccacggtttctagtcatgccacctctgtttacgctctgtgcaggcctccgctgtgcgtcaatctgtgacgtgacaagctgaatgtactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccattattcatgcccagttcctcatgccatgcacctgctgtcacccatcatgcactctatattcagggttcacttcgttgttccggggcagttttcgatcgtttcgcccgtttgctgcttctggggtactctatccccgcgatgcccccgcaccgttgttgatttggtggtggtgttttagggtgggttttgttgtttgtttgagttttagctctatgatgggttgtcctgttgttttgtcgaataaggacggtatcttcctccttttcctatttttttctccatcctcctctcacacatccctctcctccactccgccgcccgccctcctaccccttttctctcctcgctcctttgtccttcttttgatctttattcacattcttcctctcctccattctccttctctttt

SEQ ID NO: 311097 - DNA, 913 bp, Homo sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311098 - DNA, 725 bp, Homo sapiens
tctccttcccagtccttgtttggtgaggggtgaatgaggcagtctttggagagtggggtcagcctcacctaggcagggactcagttcctcccagccacagggaggctcaggagcttgtgtccaccttcaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccagcatattcccagggatcccattcccctagcccttccccttactagcgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagataaatgtgaag

SEQ ID NO: 311099 - DNA, 566 bp, Homo sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtgtgattctggagagtgacccccagcaagtgatccagaaggtgaattttagggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311100 - DNA, 409 bp, Homo sapiens
  misc_feature (46)..(46): n is a, c, g, or t
ccagtggtccgtgtggatctggcacatgacccccacagtgatccanaagtgaattttagggcagatgatggcggcttgactgaacagagtgtgggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311101 - DNA, 375 bp, Homo sapiens
  misc_feature (46)..(46): n is a, c, g, or t
ccagtggtccgtgtggatctggcacatgacccccacagtgatccanaagtgaattttagggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311102 - DNA, 1576 bp, Homo sapiens
gccttcgcggcgggcgatgttagtgggcttgggcgttgggtgaagtatccaggttgggcgcttccagcgctttctgtggcgggggaatgaaggcctaggtcagggaataggaaggtgtatcgccgccagagtgcggaacaccctcgccttgagggttcccacagtgacttgcaaaagtctagtgagacccgagaatgctgaggcgggacacgaagcatgtggttcttgtggttgcgacgctcgtgccgccatcttgggtgctggcggcggaaaccggtaccccaacttcccctcggtgcgaacctggagaagccaccccagctgtgagggacggttgcgcctcatggcccaggcaagggtaccttcgctggagcagtaccgcggacggatatcatgagggtggtgggacgttggcggaacgttggcggaacgttggcggtgtgagaggtgtggggtaatggcgattttgtcatggtagaaacagcccaaaggacccccctcgtttggcctcccacgcagcttagtcttgcttttttagggatgtttctcattttttaatttctccagtcccatctggttatattgccaaaacatgtttgtgactctcaaacgttagtttactcccagcatcacttggggagcttgctaagctacgaattccgaggtcccactggagagtctgatttaatgaccctggagtggcggccggataacctgcctgctggggtgattttaacgcagctgatgcgaagaccccatttagggaatcattgggttggcgtttgcaatgcgttcctcccagctataggacaaagaggtgtcaactcaactgtgtcttcttagaagagcccattatttatagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311103 - DNA, 1520 bp, Homo sapiens
gccttcgcggcgggcgatgttagtgggcttgggcgttgggtgaagtatccaggttgggcgcttccagcgctttctgtggcgggggaatgaaggcctaggtcagggaataggaaggtgtatcgccgccagagtgcggaacaccctcgccttgagggttcccacagtgacttgcaaaagtctagtgagacccgagaatgctgaggcgggacacgaagcatgtggttcttgtggttgcgacgctcgtgccgccatcttgggtgctggcggcggaaaccggtaccccaacttcccctcggtgcgaacctggagaagccaccccagctgtgagggacggttgcgcctcatggcccaggcaagggtaccttcgctggagcagtaccgcggacggatatcatgagggtggtgggacgttggcggaacgttggcggaacgttggcggtgtgagaggtgtggggtaatggcgattttgtcatggtagaaacagcccaaaggacccccctcgtttggcctcccacgcagcttagtcttgcttttttagggatgtttctcattttttaatttctccagtcccatctggttatattgccaaaacatgtttgtgactctcaaacgttagtttactcccagcatcacttggggagcttgctaagctacgaattccgaggtcccactggagagtctgatttaatgaccctggagtggcggccggataacctgcctgctggggtgattttaacgcagctgatgcgaagaccccatttagggaatcattgggttggcgtttgcaatgcgttcctcccagctataggacaaagaggtgtcaactcaactgtgtcttcttagaagagcccattatttatagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311104 - DNA, 1690 bp, Homo sapiens
gccttcgcggcgggcgatgttagtgggcttgggcgttgggtgaagtatccaggttgggcgcttccagcgctttctgtggcgggggaatgaaggcctaggtcagggaataggaaggtgtatcgccgccagagtgcggaacaccctcgccttgagggttcccacagtgacttgcaaaagtctagtgagacccgagaatgctgaggcgggacacgaagcatgtggttcttgtggttgcgacgctcgtgccgccatcttgggtgctggcggcggaaaccggtaccccaacttcccctcggtgcgaacctggagaagccaccccagctgtgagggacggttgcgcctcatggcccaggcaagggtaccttcgctggagcagtaccgcggacggatatcatgagggtggtgggacgttggcggaacgttggcggaacgttggcggtgtgagaggtgtggggtaatggcgattttgtcatggtagaaacagcccaaaggacccccctcgtttggcctcccacgcagcttagtcttgcttttttagggatgtttctcattttttaatttctccagtcccatctggttatattgccaaaacatgtttgtgactctcaaacgttagtttactcccagcatcacttggggagcttgctaagctacgaattccgaggtcccactggagagtctgatttaatgaccctggagtggcggccggataacctgcctgctggggtgattttaacgcagctgatgcgaagaccccatttagggaatcattgggttggcgtttgcaatgcgttcctcccagctataggacaaagaggtgtcaactcaactgtgtcttcttagaagagcccattatttatagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcggtgtgattctggagagtgacccccagcaagtgatccagaaggtgaattttagggcagatgatggcggcttgactgaacagagtgtggcccaggtctctctgctcagactaatcctgcttgtatggaacttcccgccctggcgctaactcctcgtgctgtggtggccctaccgagatgagcctgtgctgtctcgtgtggagtcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311105 - DNA, 687 bp, Homo sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagatgtgattctggagagtgacccccagcaagtgatccagaaggtgaattttagggcagatgatggcggcttgactgaacagagtgtggcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311106 - DNA, 593 bp, Homo sapiens
ttggcaaggagaaggggcggaggggaggattgtgccactgatttgcctcctggtttttcctctcatcttgtagtgtgattctggagagtgacccccagcaagtgatccagaaggtgaattttagggcagatgatggcggcttgactgaacagagtgtggcccaggtctctctgctcagactaatcctgcttgtatggaacttcccgccctggcgctaactcctcgtgctgtggtggccctaccgagatgagcctgtgctgtctcgtgtggagtcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311107 - DNA, 857 bp, Homo sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagactgatgctcatgtctgttctcacctgcctgtttgagtctctgaaccacatgttaagtgtgattctggagagtgacccccagcaagtgatccagaaggtgaattttagggcagatgatggcggcttgactgaacagagtgtggcccaggtctctctgctcagactaatcctgcttgtatggaacttcccgccctggcgctaactcctcgtgctgtggtggccctaccgagatgagcctgtgctgtctcgtgtggagtcccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgaaaaaaaaaa

SEQ ID NO: 311108 - DNA, 979 bp, Homo sapiens
ggcggcgagcggaatgcagcggcccgaggcctggccacgtccgcacccgggggagggggccgcggcggcccaggccgggggcccggcgccgcctgctcgagccggggagccctcggggctgcggttgcaggaaccttccctctacaccatcaaggctgttttcatcctagataatgacgggcgccggctgctggccaagtattatgatgacacattcccctccatgaaggagcagatggttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccacgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagataaatgtgaag

SEQ ID NO: 311109 - DNA, 209 bp, Homo sapiens
atgaccatcgtctacaagaacagcattgacctcttcctatacgtggtgggctcatcctacgagaatgaggtgaattcaggaggttggggcagtaagaagggtctgtctatggggaaatgttgttatttggaatctgggcttgaggctgggacctggaggctcaccattggaccccttcttttaggctccatggggtagaggagggcagc

SEQ ID NO: 311110 - DNA, 1289 bp, Homo sapiens
  misc_feature (1127)..(1129): n is a, c, g, or t
  misc_feature (1131)..(1131): n is a, c, g, or t
  misc_feature (1135)..(1135): n is a, c, g, or t
  misc_feature (1137)..(1137): n is a, c, g, or t
  misc_feature (1139)..(1139): n is a, c, g, or t
  misc_feature (1165)..(1165): n is a, c, g, or t
  misc_feature (1172)..(1172): n is a, c, g, or t
  misc_feature (1179)..(1179): n is a, c, g, or t
  misc_feature (1185)..(1185): n is a, c, g, or t
  misc_feature (1190)..(1191): n is a, c, g, or t
  misc_feature (1197)..(1197): n is a, c, g, or t
  misc_feature (1205)..(1205): n is a, c, g, or t
  misc_feature (1215)..(1215): n is a, c, g, or t
  misc_feature (1232)..(1232): n is a, c, g, or t
  misc_feature (1234)..(1234): n is a, c, g, or t
  misc_feature (1265)..(1265): n is a, c, g, or t
gataatagagaaattaacagcttgaagaaataacaaaaagttcagtgagttagcatgaaactatacctgaaagttattgcaaggttaagtgagaggaaccttaaaattaaagggagcagcatttgtaaagaaaagctagaatcatgaaaagacctaagataagatcaaatgaaattacgtagaagtgtaaaattcttaactgttagtatctgaaaatcatgcattccttgctaggaaggcatggcattagtgctgtcggaatcctgataaaacatcacaaacttctgttcgttggtattagggacagtatagagtgagtgcttgaagaactgccttggcttaccaatctctctctccacaacttccaatcatctctagggaacctagcagaaacacttccacagagcaaaagttataatacagaaagtgatgaaaggaggacgcaggctctcaatgacgtcaggtattcccgggacccgcccaccgtgggcgttttccacctacaggcaggcgtctccgggggcggggcttgctcagggttaacgtcactactgagcgccgggcgcgttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgaaaaaaaaaaaaaaaaaaannngngggngntnttttttcgggggggggaaaaaggggnttggaangggcctngggcanaagtnngtttcntggacccnagtttttttngtcaagggggaaaaatngngggggcccccaaaaaggggggcgggaaaaanttcggaaaacccgggtaaaccggt

SEQ ID NO: 311111 - DNA, 1262 bp, Homo sapiens
gataatagagaaattaacagcttgaagaaataacaaaaagttcagtgagttagcatgaaactatacctgaaagttattgcaaggttaagtgagaggaaccttaaaattaaagggagcagcatttgtaaagaaaagctagaatcatgaaaagacctaagataagatcaaatgaaattacgtagaagtgtaaaattcttaactgttagtatctgaaaatcatgcattccttgctaggaaggcatggcattagtgctgtcggaatcctgataaaacatcacaaacttctgttcgttggtattagggacagtatagagtgagtgcttgaagaactgccttggcttaccaatctctctctccacaacttccaatcatctctagggaacctagcagaaacacttccacagagcaaaagttataatacagaaagtgatgaaaggaggacgcaggctctcaatgacgtcaggtattcccgggacccgcccaccgtgggcgttttccacctacaggcaggcgtctccgggggcggggcttgctcagggttaacgtcactactgagcgccgggcgcgttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgagtgatgtgtgtgtttgtattttttttctggcatgaaatatctcaagtaaatgcataggactatttaacccttttatgggaattactattatttttattttaaatgtcctctagttcagtttgcttttgttttgttgctgctgcaaatattttat

SEQ ID NO: 311112 - DNA, 1334 bp, Homo sapiens
  misc_feature (1172)..(1174): n is a, c, g, or t
  misc_feature (1176)..(1176): n is a, c, g, or t
  misc_feature (1180)..(1180): n is a, c, g, or t
  misc_feature (1182)..(1182): n is a, c, g, or t
  misc_feature (1184)..(1184): n is a, c, g, or t
  misc_feature (1210)..(1210): n is a, c, g, or t
  misc_feature (1217)..(1217): n is a, c, g, or t
  misc_feature (1224)..(1224): n is a, c, g, or t
  misc_feature (1230)..(1230): n is a, c, g, or t
  misc_feature (1235)..(1236): n is a, c, g, or t
  misc_feature (1242)..(1242): n is a, c, g, or t
  misc_feature (1250)..(1250): n is a, c, g, or t
  misc_feature (1260)..(1260): n is a, c, g, or t
  misc_feature (1277)..(1277): n is a, c, g, or t
  misc_feature (1279)..(1279): n is a, c, g, or t
  misc_feature (1310)..(1310): n is a, c, g, or t
gataatagagaaattaacagcttgaagaaataacaaaaagttcagtgagttagcatgaaactatacctgaaagttattgcaaggttaagtgagaggaaccttaaaattaaagggagcagcatttgtaaagaaaagctagaatcatgaaaagacctaagataagatcaaatgaaattacgtagaagtgtaaaattcttaactgttagtatctgaaaatcatgcattccttgctaggaaggcatggcattagtgctgtcggaatcctgataaaacatcacaaacttctgttcgttggtattagggacagtatagagtgagtgcttgaagaactgccttggcttaccaatctctctctccacaacttccaatcatctctagggaacctagcagaaacacttccacagagcaaaagttataatacagaaagtgatgaaaggaggacgcaggctctcaatgacgtcaggtattcccgggacccgcccaccgtgggcgttttccacctacaggcaggcgtctccgggggcggggcttgctcagggttaacgtcactactgagcgccgggcgcgttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtgagattccatcccttctcgggctgggaatggggcacgggagaggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattaaatattggctataagtgaaaaaaaaaaaaaaaaaaannngngggngntnttttttcgggggggggaaaaaggggnttggaangggcctngggcanaagtnngtttcntggacccnagtttttttngtcaagggggaaaaatngngggggcccccaaaaaggggggcgggaaaaanttcggaaaacccgggtaaaccggt

SEQ ID NO: 311113 - DNA, 870 bp, Homo sapiens
gaaaatgcctcatgacgttagatttgggaataatttattggatatgataccaaaagcacaggcagcataagcagaaatagacaagtgggattacatcaaactttgaaacttctgctcggcaaagaaaacagcagagtgaaaagacaacctagaatggaagcaaaccgtatctctgataaggggatagcacaaggggctaatatatacaatatatacgcaactcctgcaacttaacaaatgaaaacaaaccaattaaaaaatacgcaaagggcttgaatcaacagttttctaaagaagatatacacatgaccaatgagcgtatgaaaactgctccacagccagagctgtggcatgcacctgtatgtaggcccagctacttgggaggctgaggtggaaggaccacatgagcccaggagttccaggccaggctgggcaaaagagaccccatctctaaaaaagaaaaaagatgctcactgacactaatctttagagaaatgcaaatcaaaactacaccttttaggatggctgctgtcaaaggaaaaaaaaaaaaaaccaggaaataaatgttggcgaggatgtggagaaattggaagtcttgtacacttttggtgggaatgtaaaatgctgcagttgctatggaaaatagtatagaggttcctcagaaaactaaaaattgatccagcaatcccactgctggttataccaccaaaagaattgaaaacaggattgcccagtggtacttttacacttatgtccagtctagcatttttcacaagagccaagaggtggaagccacctcaatattcatcaacagatgaatggaaaaagaaaatctggtatgtatctaacagtggaatattatccagcttt

SEQ ID NO: 311114 - DNA, 959 bp, Homo sapiens
cggctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaagagcagccagccggccaagttcctggtgacattctgcgcctcggatgcgccggagaggtccttgctggccgaccgggaagacagtctgcccaagctctgccatgcatgggggctgcacagcaacatcagcggcatgaaggagcggctgtccaacatgcagaccccaggtcaagggagccccctgcctgggcagccaagatcccaggaccatgtcaagaaagattctttaagggagctttctcaaaaaccaaaactcaagaggaagaggataaaggaagccccagaaactccagagactgaaccgtaagaagaccaactgggacaaagggcccgcttgtcctggctctcagagcacggggaatggagaccaaaaagggaaaagaattgtccttatcaaaaagattctcaggtcttaattaggaataaatgaggtgggaaataaacattcttatgacagttctaccttaaaga

SEQ ID NO: 311115 - DNA, 872 bp, Homo sapiens
gcccaccgcgtttccgccctcggcctcgggtccctggagggctcgcgggtgacaaatgtgtcatgcctggagacaagctccagcgccagccctgctagagactcgctcatgcgccatgccaagggcctggatcaggacaccttcaaaacttgtaaagaatacctaagaccgctgaagaagttcctgcgaaagttgcacctgcccagggaccttccccagaagaagaagctgaagtacatgaagcagagccttgtggtcctaggggaccacatcaacacctttctgcagcattactgccaagcctgggaaatcaaacactggagaaagatgctctggcggttcatctccctcttctcggagctggaagcaaagcagcttcgccgactttacaagtacaccaagagcagccagccggccaagttcctggtgacattctgcgcctcggatgcgccggagaggtccttgctggccgaccgggaagacagtctgcccaagctctgccatgcatgggggctgcacagcaacatcagcggcatgaaggagcggctgtccaacatgcagaccccaggtcaagggagccccctgcctgggcagccaagatcccaggaccatgtcaagaaagattctttaagggagctttctcaaaaaccaaaactcaagaggaagaggataaaggaagccccagaaactccagagactgaaccgtaagaagaccaactgggacaaagggcccgcttgtcctggctctcagagcacggggaatggagaccaaaaagggaaaagaattgtccttatcaaaaagattctcaggtcttaattaggaataaatgaggtgggaaataaacattcttatgacagttctaccttaaaga

SEQ ID NO: 311116 - DNA, 330 bp, Homo sapiens
agatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaattt

SEQ ID NO: 311117 - DNA, 335 bp, Homo sapiens
taaagtgctgtactaaatggccgttacctaaaaggctgctggattgggcgatcacgagtgccatttaggtacagccattaggtacagccatttaggacctaaatggctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaattt

SEQ ID NO: 311118 - DNA, 372 bp, Homo sapiens
ggataaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagcttttt

SEQ ID NO: 311119 - DNA, 587 bp, Homo sapiens
aggtaacaaagcaccacattagatactgaagatagaaatttgcttaagatatggtctcagcattcaacaggctggtgttctggttgagaaggagtacatggatctttctttctcctacccctggagactagttcaagcgattctcctgcctcagcctctcaagtagctgggactacagtatcctgcataaaactgcattaaaaaccagtaacatcagacccgggatggggacggaaggtccaaatcagaacctccatggaatgcatctctacatattttcacatctgttttcaagcaaggagcaagaccagcaagaaagtgaggacttcctctgatgcacaaacctgggatgtgctgtgcaaatcagctacctgggcttcccacctgtggatgctcactgacctggggccgcaccaggtgatttcaggacttcctcagagaaaacccaggcaagacaccagcaacagagctaccctgataattattaaattagctctatgtggagaagccatatttgaataagttattagtggaggtcctttgtaaaccatgctccattatataaatggcagatgtcattatttata

SEQ ID NO: 311120 - DNA, 555 bp, Homo sapiens
actaagcaagacaaacacaaagcagcaagtgcagtgaatcagagatagtatcccagcaaccagccccagaggaccagctgtggtttggaggtgacaggagcagcagccatccacacctgccatccaaacctgccatccacagctacttgagttctccagacctaggaaagacaaagtctcactctgctgtccaggctggagtgcagtggcgcgatctcggctcactgcaacctctgcctcccaggttcaagcgattctcctgcctcagcctctcaagtagctgggactacagacttcctctgatgcacaaacctgggatgtgctgtgcaaatcagctacctgggcttcccacctgtggatgctcactgacctggggccgcaccaggtgatttcaggacttcctcagagaaaacccaggcaagacaccagcaacagagctaccctgataattattaaattagctctatgtggagaagccatatttgaataagttattagtggaggtcctttgtaaaccatgctccattatataaatggcagatgtcattatttata

SEQ ID NO: 311121 - DNA, 515 bp, Homo sapiens
aggtaacaaagcaccacattagatactgaagatagaaatttgcttaagatatggtctcagcattcaacaggctggtgttctggttgagaaggagtacatggatctttctttctcctacccctggagactaacaaagtctcactctgctgtccaggctggagtgcagtggcgcgatctcggctcactgcaacctctgcctcccaggttcaagcgattctcctgcctcagcctctcaagtagctgggactacagacttcctctgatgcacaaacctgggatgtgctgtgcaaatcagctacctgggcttcccacctgtggatgctcactgacctggggccgcaccaggtgatttcaggacttcctcagagaaaacccaggcaagacaccagcaacagagctaccctgataattattaaattagctctatgtggagaagccatatttgaataagttattagtggaggtcctttgtaaaccatgctccattatataaatggcagatgtcattatttata

SEQ ID NO: 311122 - DNA, 620 bp, Homo sapiens
aggtaacaaagcaccacattagatactgaagatagaaatttgcttaagatatggtctcagcattcaacaggctggtgttctggttgagaaggagtacatggatctttctttctcctacccctggagactagttcaagcgattctcctgcctcagcctctcaagtagctgggactacaggaacaaacgaattgtttttttcaacttgacaagtatcctgcataaaactgcattaaaaaccagtaacatcagacccgggatggggacggaaggtccaaatcagaacctccatggaatgcatctctacatattttcacatctgttttcaagcaaggagcaagaccagcaagaaagtgaggacttcctctgatgcacaaacctgggatgtgctgtgcaaatcagctacctgggcttcccacctgtggatgctcactgacctggggccgcaccaggtgatttcaggacttcctcagagaaaacccaggcaagacaccagcaacagagctaccctgataattattaaattagctctatgtggagaagccatatttgaataagttattagtggaggtcctttgtaaaccatgctccattatataaatggcagatgtcattatttata

SEQ ID NO: 311123 - DNA, 241 bp, Homo sapiens
atctgcagacttaatgctttttctttttgcttatttcttttctctttgatgctactcataagtttcttcttccctctctgtttctgtgccaactttaggttgagttgagacaatgtgcttgacaggtaaacctgtaatttgtgattggataataaagcattattatctgaaacttgttcttacagatacctttagaaaatgcttgaagaggccaggtgcggtggctcacgcctgtaatcac

SEQ ID NO: 311124 - DNA, 2766 bp, Homo sapiens
ccgcagccggggctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctcccccttcgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311125 - DNA, 1906 bp, Homo sapiens
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311126 - DNA, 2685 bp, Homo sapiens
ccgcagccggggctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctcccccttcgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311127 - DNA, 2532 bp, Homo sapiens
cgcgctcagacgccccagctccgccgagaggccgctcgcgccgggtccttcctcttccccaagtgcaggcagagcccccggagccatggccagcccttccggcagctccgaagccactggcaagccccgaggcaggatggccggcccaggagggaggaggacgacgtccctcccgaagagaagaggctgcggctggggctggaggggggaagcgcacagcccgaggactgcgaggacgggaaggacgcgccgcggccgggcagggaggagaccggcacccagacaggtggcgacggcagaggagatctactgtgcctgccatacagcctggttgagggtcaggactacaagtctgaaaattcaaccctcctccccggtgccaagaacagcctgcaagactccgtttcggcaagtcaggctacaggcaaagctgaggaaactggtcaaagaactcatgcaagtggaacttacagcttccttgatcggactcagcattcagatatcaaagcagactgcaatacctgcgtggaaatagaagacagaaaggttgaaccagcaaacgggtgacagtgagaggaaggaacaagcatgtgaacaaatgcgtgaaccacagtcagtctctgaatggaaatccatgtgtcttatgaaaatcagttatgttgaaagccatttgcaaagcttccacgatcctcgctttggctggtgcacggctgtgaagtgctttctttccaagctctcctgtgggtgacgggggaatggggtaaccagggcatttgtgttcacaggcatatcgattccaagtctgatcacagccacaaatttctttcccaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311128 - DNA, 2726 bp, Homo sapiens
ccgcagccggggctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctcccccttcgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311129 - DNA, 1888 bp, Homo sapiens
cggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311130 - DNA, 1802 bp, Homo sapiens
ctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctgggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311131 - DNA, 2819 bp, Homo sapiens
ccgcagccggggctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctcccccttcgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311132 - DNA, 1194 bp, Homo sapiens
ccgcagccggggctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctcccccttcgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggcctctccagccctcttttcctcctgtgggccacacttttgcccaatgagatatccactagtcctttagcctgacacctggccaccca

SEQ ID NO: 311133 - DNA, 803 bp, Homo sapiens
atagagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311134 - DNA, 1884 bp, Homo sapiens
ctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311135 - DNA, 1279 bp, Homo sapiens
ttttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaa

SEQ ID NO: 311136 - DNA, 1821 bp, Homo sapiens
aggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattcca

SEQ ID NO: 311137 - DNA, 2445 bp, Homo sapiens
aggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattccattgaatctcgcacccagtcttgcgtatgcctgcccagttttcagcctcttaacgggagactcaagcacattggtattgtataaaggtatagagcacttagcttacaatctttaaaggtttctctgccttcccttctacccacccgcctcccaccagatcccatctggaaatcataataaagacatatgccactttgacaaacctgactagtccttactagcctgagggtaaaagattaagctccaacctcaagtcatttacctggtcttggtaataagtttcttttagcttgtacagcatcctcagaccaactgaggagctttccttgttaacaatttagcttatctttctgtttcctttatttttcccctgcctctgttagtggttaacactcttttccctcagggagcctaatgaggtttttaatatcatctaaaaataaagcattgaagtgaagttggtgaaaatttgttcctggtctaatttggcacccttccaacctgagtattgtaggggaaggaaatttacaagatttaataggaaatgaaacagcttgaatttcaaactaaattgtattttcagagctatcctgaaactgaacagctgaaactttaaaaaataatt

SEQ ID NO: 311138 - DNA, 1252 bp, Homo sapiens
  misc_feature (320)..(320): n is a, c, g, or t
aggtcaggtgacgcggccggcgtcccaagatggcggcggcggcggctcccggaaggccgcggcggcgtcccggctgctaaggcgggccccacgcggctggcagcggacaggccggacctacggggcttgtactagtcaggaaccggctctctagcgtctagtggcgattagtggagtccgaaacgttgtggcgaatgagcatcgcagggatatgcttctttagtctgggtctctaggctctctgccctgcgtcgtctatagtggcgtgctgagcggggcccggcgccccgtgtgctccctggagcctaagagttgcttanagggatatattacgaaattaagggagaggggcgataagaaacgttgtaaggatttgagagtacgattgaagatatggaggcgtagaagaggatttaattacttgttgagaataccagaactacaggctccattctgataagtagtgatcagacgttgaggtataagagcgcggggtatatctagagtctggggaagcgttggattgggaatatttctatatctattaattgcagactcgaggattatcaagagtgcacgatcagaccaaggagcgggagtagaacgtagaagttcgggagatcgctaaaggtgatctcaaattgaaggacctaagtacctttagaagtagggacttagggaaagtctgggggtatataacagtagtctgtttttaagcagaacatattggttagtccagataaatttagttgtcagattagccagagtgtttaccaggccgttaagtttgggggttagtataaggagagtgttgaatgtgggttaagtggcaaggggcatgatcggagagactaaaagaatttcctttgggccctggagaagaaggttggtatattatggggaagaaggtttccgaaaagaaatttgagaaatctatcattagaggggagtgagagattttagtagcgtgatttataaccgataaggggagagaaagagaagatgaagcttaatctggagagagccaacttaatgggggagttaagttatttgaactaagggcactgggtagttagatttatggagttggatccgttgcgggcaggaatcgcaaccttgagagaggcctgggagaggtgtcgagttatttattaattttggggaaggagagcggattgtgatcgtttcgaaggggttgattccagtttgagattgaaatgcgtatcggtgattaggggagattgcgaggaag

SEQ ID NO: 311139 - DNA, 1739 bp, Homo sapiens
aggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggtttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattcca

SEQ ID NO: 311140 - DNA, 1163 bp, Homo sapiens
ttttacttcagtgaaacctgtcaaattgcatctgcaaaattgttgtgtctgagaaagttaaagctcactcccttcccttttctcatcttggtttaggtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattcca

SEQ ID NO: 311141 - DNA, 1075 bp, Homo sapiens
aggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttcaagttatatattcccttttcaggggaacctctagg

SEQ ID NO: 311142 - DNA, 1428 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311143 - DNA, 624 bp, Homo sapiens
ccacgcgtacgcccacgcgtccgggtgttcacccgcgttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311144 - DNA, 732 bp, Homo sapiens
  misc_feature (699)..(699): n is a, c, g, or t
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcccgccgccgcatgccttntcaacagccacaacgcactgaactgccttccgg

SEQ ID NO: 311145 - DNA, 413 bp, Homo sapiens
tatacggctgttagaagacgacagaagggaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311146 - DNA, 494 bp, Homo sapiens
gctgacggcggttggatacagcgtgttctggctcagtctggcgtctggcggggctcgagtggacgaatactactgtcgtccgcacaacgagcgcgtggtggcggtggcgagagttctgcaaagtgcatctcttccagatacgccgtgcgctcgtgccaagtcgcccgagctcgcatgtactggggggcacacgggagacacacttgaccagcgtacgattcacgcacgacaactcgcacctcgtactcgcatgggctgcgataaggacgccagaattttccagtggccgagtgctggagcagctagggcgcgtcggctggggccgtgacgcccatcgcgtcgcgcgtcatcggaaccacccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311147 - DNA, 1568 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaaaatggggggtttattgggggggggaaaaggggttgaagggaatgggatgggtttgggaccattttgtgaagggggattggggggtcccaaggggggggaattatgaaagcggtacg

SEQ ID NO: 311148 - DNA, 1997 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaaaaaaaaaaaacctccggggccttttttgtgcggggtgggggaaaaaggggttttgagaaggggcccgtgggccattgtgtgttcccggcccccgttttttgtgtccccgggggggaaaccggggcggggccccccaatagggggggcggaaaaaatccggaaaagccggggttcccctgttagttcttcgtggcagcgagaatccgggggaaattaacccccccataaaagagggggggtcttgggagaccacacagagggactcgtggggaaaccactttgacgggggagaaaccgccggagtgagaacaaaaaaaacaccgggatccacagggggggtggggcgcgagagaaggaacacccacttaccgagggaagggggttagagaggaggacaaccaaaaggggcctagagcccgagtagggcccaataaggttagtaacggtaaacacctagcgaaccatacaggattcgcagagaggaacgcttcgggagcaaacaagtcgagatggcagaggagggagtaagcacggagacaccagaa

SEQ ID NO: 311149 - DNA, 1776 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaagggggggggccaaaaaattccccgggggggcccccatagcgaccccaggtttctggggaagcggggcccaacaggggagcgaataaaaacgaaggagcgggcggggtttacaccgtcgggcgggacacggcagcggcttgggagggcccccctgcggcggggcaaggcaccccccaaacgataaaagccagggaatacacaccggaggggcacccgacctggggaacgccgatattaagcagcacggagagtacaagggacgacatcagagaccagtagacgcacagaccagaaaaagcaaacaacacgaaacacacgaacgcca

SEQ ID NO: 311150 - DNA, 1723 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaacaaacacaacaacacaccacaaaaccaacacaacaacacaaccaaaaaaggacacacacaaacggggggggcgatggctcaagaaacttcccgcggggggggccacatgagtgtgcggcctggccccgatttttgtgggcgacaggcggcgcccccagaacgggagcgcatatctaaaagcccgggcgcagggtcgcggttataaacggctcgcggaggcgacaacaccgcgcatcgcgggaatctgggagagaacctacactcgggggtgaccattggggacacacccc

SEQ ID NO: 311151 - DNA, 1610 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaagaaaagagaagaggacaaacacccggagagaaaccacaaggtggagaggcggaaaaccggcggtcacgagcaacggggcccatgggcaaagcgggtacagtaccccagctcgtcgacacacgcgcagaacccgcggaccgaaaagtacacgaactaacccgaaagccggtaccggcctag

SEQ ID NO: 311152 - DNA, 1472 bp, Homo sapiens
  misc_feature (59)..(59): n is a, c, g, or t
  misc_feature (67)..(67): n is a, c, g, or t
  misc_feature (88)..(88): n is a, c, g, or t
aaaaaccaaaatcgcggctatgtgtatccggaggtcctcgtgcgcgcgttttttaaaanttgctgcnacgagggggagctgcgacggnacggagcgcccccgcccccgccggcgccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311153 - DNA, 1390 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311154 - DNA, 2098 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcctgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311155 - DNA, 1507 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311156 - DNA, 1367 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacagcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311157 - DNA, 1239 bp, Homo sapiens
ccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311158 - DNA, 1500 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311159 - DNA, 1304 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctgattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311160 - DNA, 1883 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311161 - DNA, 2170 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcctgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311162 - DNA, 618 bp, Homo sapiens
atttaaacatatataataaaaatttattatttctctgtttaacccaccttccattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311163 - DNA, 621 bp, Homo sapiens
cccaccaaccactaccacggcaagtacccgtcggcggcggagggagagagcagctattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311164 - DNA, 544 bp, Homo sapiens
gggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcatgattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctg

SEQ ID NO: 311165 - DNA, 1762 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaggggggggccaaatttcccccgggggccctttcgcccttttttgacagggcccctagggggcatataagggaggaggcgggcggggttaacagctccgacgggaaagcctctgggatcttggaagacccctctcgggctgcacttgggaccccccagattaggccgtcaataatcggttaaggtagaccggcttcctggctggattgctgtttgataccatcagagacaattgtagcgcaaacaggagttcgacgagcgtacaccaaactcctcatgcactccatgccgcctcactcgcgaagaaacaagg

SEQ ID NO: 311166 - DNA, 1891 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaaaaaaaaaaaaaaaaaaaaaaaaaaaaaaaaaaaaggggggggcccccaaaaaaatcccccccggggggccccacacaaaacaacgcgcgcacccccagatttgcgggaaaaagggggcgccccaaaaggggcgcccaatatacaaaaccaacacgcgggcgcgcgcgacggccacacaaggggggcgagggggaaaaagagcggccccccggggcaccttgggcagagaggagcccccatacaggaggggggcgcacacggggggccaacacacccccaacggcgaactatacacgccccaacgcggaaacacaacaacaccacacgcgggacaacgcggcccacacaacacccgcacactacccccccgcgcaccaaccacaccggaacgaggaaaacaaccccccacacaattccaccggccccacacaacaacccc

SEQ ID NO: 311167 - DNA, 1950 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaaaaaaaaaaaaaaaaaaaaaaaaaacaaaaaacaaaaacaccaacaacaacccaaaaccaaaaacacgacaacactccactaacaaaataacaacattgaagtactcatgcaacatcaaccaccacgtcacccactttttaccatcgcttctctgacactccccctctcaccctctcctttactttgtcacaccgctcccccgcccgcttctctccatctcactctccctcacgccctagcctccactccccccttccctcccctcactccatcaccctcacgcaaccatcaccaactctctcccagccctttcccctcactccctgcacaccccctccccacatcaccacatactacccctctccccacccacaatcaccacacacaacccacctaccactcctccaactactcccttacctcttccccatcttacccatcccactatccatccccttcccccccactctccacgccccctcaccctaccccccaccc

SEQ ID NO: 311168 - DNA, 1394 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgaaccgaacagcctgtgttctaacttatgctgggaggcacatgcccctgatgtcgcgttgggagcttactgtgtagctcgcaccggtaagtattttggtaaatgggtctgatataggtgggcgcaaaaaaaaaaacccgttttgggg

SEQ ID NO: 311169 - DNA, 1294 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacaatgctacaataaaggacacagaaatgggggaggtgggccgggggtcctggggtctccgtggtcaggagtgccctggagcgtgg

SEQ ID NO: 311170 - DNA, 1397 bp, Homo sapiens
ctgcggtgtctaggcacccgccaacgttcggccaagtgtcagccggcagcgacggcgctagagctgggagctggggacgcgcgcgccggaccttacatagcctccgcccacagcctgaggcgccggggcctgaggagccggggggcgggggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311171 - DNA, 1311 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaacgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311172 - DNA, 1811 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311173 - DNA, 1765 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactccccagcagggatgtgggtgccccagcatcagtccccccgggggatttccggcactggggagtctcagggcctgtaggggtttcaggcaggccttctccctcataccctcttctccgtctgcatgattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311174 - DNA, 1049 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagtttccgagtccgctgcattgggatcctctagatcagactcgca

SEQ ID NO: 311175 - DNA, 1091 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttgcgcctgggtgcagaagtgcgcctgggtgcagaagtgcgcctgggtgcagaagtgcgcctgggtgcagaagtgcgcctgggtg

SEQ ID NO: 311176 - DNA, 1118 bp, Homo sapiens
aggaggcggggcggcccgggcccggcgacgggggggggcgggcgcggggcccgggggcggacccgcccacacgggacggccggcggcacgcccgcgaggccagaccgcccaccccgcaccggcggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311177 - DNA, 1694 bp, Homo sapiens
ccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311178 - DNA, 818 bp, Homo sapiens
gcgggcatggcccgcggccagcagcagggcgacacgggcttgtcgaagaggaagtggtcgtcgatgagctggcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311179 - DNA, 685 bp, Homo sapiens
cggcagctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccttctcagaggtggagctggtgcagatggtggtggacggagtgaagctgctcatcgagatggaacagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 311180 - DNA, 689 bp, Homo sapiens
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311181 - DNA, 562 bp, Homo sapiens
atccagtgggtggaagttacagggagtctgcttccagtgctgctccaggaaggatccatccaccagagctgccccacatggaccatggtcaggcagaggaagatgcaaaggataaagccagatgacctcaaaggtctcatgagattctaatctgtccgctccttgttctacaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311182 - DNA, 293 bp, Homo sapiens
  misc_feature (22)..(22): n is a, c, g, or t
ccctttggaaaaggccccgcgngaaaatggtcttttctccacattagaagacaaacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311183 - DNA, 317 bp, Homo sapiens
  misc_feature (66)..(66): n is a, c, g, or t
ccttttttttccccccgcccctttttttccccccccccccaaaaaatttattaaaaaacccttttnccccaaaaggggggaaaaaaaccctctccccctttcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311184 - DNA, 309 bp, Homo sapiens
  misc_feature (58)..(59): n is a, c, g, or t
agagagagggggggggggggaaaaatttttttttttccccccccccccccccccccannaaaccccccccccgcccacaaaaaaggtgttttccccctggggtgccccctcttttcctttaaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311185 - DNA, 809 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311186 - DNA, 866 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcaaaaaaaaaaaaccaaataatatgcggcccgattcgggctacttgccaattccccttg

SEQ ID NO: 311187 - DNA, 1355 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaagtaagtctacttttgcagctgctatttcaagtcaaggtgtaggcagagtccttttttctagtcatggctggcaaacagtgggatctggggatgggacaaaaggcagctaggaagattgccatgtagtctgctgctaaatgtagagtctagtagatattcaataacattcaagttcctattttcttaagaattagcaaccagcagaggaaaacgatgggctggaagtcagactgttgaattggctctgcctttaattatttgttcaagcaagcccctgtccctctctgtgccttggtttccccatctgtcatatgaagggagtgcgatgtgttctgagactgaatccagttccaatcttctagatttctttctcgttcttctctgaagatccactattcaaaataagactcctgctcatgttaggtgggaatggatatttggggttctggtagctccacagggatgctcaatgaagatgcaaaattagaagtcaaaataaacagctcccacgggcagtgttgatctcaccctggcctttcctttcagtgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311188 - DNA, 845 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcatggaaatgaacaacctaatacaataacacggcacat

SEQ ID NO: 311189 - DNA, 875 bp, Homo sapiens
  misc_feature (827)..(827): n is a, c, g, or t
  misc_feature (833)..(833): n is a, c, g, or t
  misc_feature (838)..(838): n is a, c, g, or t
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagatgcgcgccgtccaacntatatngtgantaattcattattcccgatctatcgagccgtccaatta
